United States Patent 11,692,002 (RNA SEQUENCE ADAPTATION) - sequence listing, part 3

SEQ ID NO: 6642 - RNA, 1698 nt, Artificial Sequence
  derived and/or modified CDS sequence (AUadapt) from InfluenzaA__ADW09241__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagaugcgcgagcagcuguccagcguguccucguucgagcgguucgagaucuucccgaaggaguccagcuggcccaaccacacggucaccgggguguccgccagcugcucccacaacggcgagagcuccuucuaccgcaaccuccuguggcugaccgugaagaacgggcucuaccccaaccugagcaaguccuacgccaacaacaaggagaaggagguccuggugcucuggggcgugcaccacccgcccaacaucgucgaccagaagacccuguaccggacggagaacgccuacgugucgguggucagcucccacuacagccgcaaguucacccccgagaucgccaagcggcccaaggugcgcgaccaggaggggcggaucaacuacuacuggacccugcucgagcccggcgacaccaucaucuucgaggccaacggcaaccugaucgcgccgcgcuacgccuucgcccugucccggggguucggcagcgggaucaucaacuccaacgcccccauggacaagugcgacgccaagugccagacgccccgcggcgcgaucaacagcucccuccccuuccagaacgugcacccggucaccaucggcgagugccccaaguacgugcggucggccaagcugcgcauggugaccgggcugcggaacauccccuccauccagagccgcggccucuucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccugaacaagaagguggacgacggcuucaucgacaucuggacguacaacgccgagcuccugguccugcucgagaacgagcggacccuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcgugaagcuggaguccauggggguguaccagauccucgcgaucuacagcaccgucgccagcucccuggugcugcucgugagccugggcgccaucuccuucuggaugugcagcaacggcucccugcagugccggaucugcaucuga

SEQ ID NO: 6643 - RNA, 1698 nt, Artificial Sequence; identical to SEQ ID NO: 3861
  derived and/or modified CDS sequence (AUadapt) from InfluenzaA__ADW09252__HA

SEQ ID NO: 6644 - RNA, 1698 nt, Artificial Sequence
  derived and/or modified CDS sequence (AUadapt) from InfluenzaA__ADW09274__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgugaagaacgggcuguaccccaaccugagcaagcccuacgccaacaacaaggagaaggagguccucgugcuguggggcgugcaccacccgcccaacaucgucgaccagaagacccuguaccggacggagaacgccuacguguccguggucagcagccacuacucccgcaaguucacccccgagaucgccaagcggcccaaggugcgcgaccaggaggggcggaucaacuacuacuggacccuccuggagccgggcgacaccaucaucuucgaggccaacggcaaccugaucgcgccccgcuacgccuucgcccucucgcggggguucggcuccgggaucaucaacagcaacgcccccauggacaagugcgacgccaagugccagacgccccgcggcgcgaucaacuccagccugccguuccagaacgugcaccccgucaccaucggcgagugccccaaguacgugcgguccgccaagcugcgcauggugaccgggcuccggaacauccccagcauccagucccgcggccuguucggggccaucgccggcuucaucgagggcggcuggaccggcauggucgacgggugguacggcuaccaccaccagaacgagcaggggucgggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuacccgaaguacagcgaggaguccaagcugaaccgcgagaagaucgacggcgugaagcucgagucgauggggguguaccagauccuggcgaucuacuccaccgucgccagcagccuggugcuccuggugucccugggcgccaucagcuucuggaugugcuccaacggcagccuccagugccggaucugcaucuga

SEQ ID NO: 6645 - RNA, 1698 nt, Artificial Sequence
  derived and/or modified CDS sequence (AUadapt) from InfluenzaA__ADW09285__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucucgguggugagcucccacuacagccgcaaguucacccccgagaucgccaagcggcccaagguccgcgaccaggagggccggaucaacuacuacuggacccuccuggagcccggcgacaccaucacguucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacucgucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacccagaacgccaucaacggcaucaccaacaaggucaacucggugaucgagaagaugaacacccaguucacggccgucggcaaggaguucaacaagcuggagcgccggauggagaaccucaacaagaagguggacgacggguucaucgacaucuggaccuacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacucgacgguggccagcucccugguccuccuggugagccugggcgccaucuccuucuggaugugcagcaacgggucccuccagugccgcaucugcaucuga

SEQ ID NO: 6646 - RNA, 1698 nt, Artificial Sequence; identical to SEQ ID NO: 3861
  derived and/or modified CDS sequence (AUadapt) from InfluenzaA__ADW09296__HA

SEQ ID NO: 6647 - RNA, 1698 nt, Artificial Sequence; identical to SEQ ID NO: 3376
  derived and/or modified CDS sequence (AUadapt) from InfluenzaA__ADW09307__HA

SEQ ID NO: 6648 - RNA, 1698 nt, Artificial Sequence
  derived and/or modified CDS sequence (AUadapt) from InfluenzaA__ADW09327__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagucgaagcugaaccgggagaagaucgacggggucaagcucgaguccaugggcguguaccagauccuggcgaucuacagcaccguggccagcucccugguccuccuggugagccugggcgccaucuccuucuggaugugcagcaacgggucccuccagugccgcaucugcaucuga

SEQ ID NO: 6649 - RNA, 1698 nt, Artificial Sequence; identical to SEQ ID NO: 3861
  derived and/or modified CDS sequence (AUadapt) from InfluenzaA__ADW10483__HA

SEQ ID NO: 6650 - RNA, 1698 nt, Artificial Sequence
  derived and/or modified CDS sequence (AUadapt) from InfluenzaA__ADW10494__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucucgguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacucgucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacucggugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagaaccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggggucaagcucgagagcaugggcguguaccagauccuggcgaucuacuccaccguggccucgagccugguccuccuggugucccugggcgccaucagcuucuggaugugcuccaacgggagccuccagugccgcaucugcaucuga

SEQ ID NO: 6651 - RNA, 1698 nt, Artificial Sequence; identical to SEQ ID NO: 3861
  derived and/or modified CDS sequence (AUadapt) from InfluenzaA__ADW10505__HA

SEQ ID NO: 6652 - RNA, 1698 nt, Artificial Sequence; identical to SEQ ID NO: 3861
  derived and/or modified CDS sequence (AUadapt) from InfluenzaA__ADW10516__HA

SEQ ID NO: 6653 - RNA, 1698 nt, Artificial Sequence
  derived and/or modified CDS sequence (AUadapt) from InfluenzaA__ADW10527__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggcugggcaucaucaacagcaacgcccccauggacaagugcgacgccaagugccagacgccccagggcgcgaucaacuccagccugcccuuccagaacgugcacccggugaccaucggggagugccccaaguacguccgcuccgccaagcuccggauggugaccggccugcgcaacauccccagcauccagucccgggggcuguucggcgccaucgccggguucaucgagggcggcuggaccgggaugguggacggcugguacggguaccaccaccagaacgagcagggcucgggguacgccgcggaccagaaguccacgcagaacgccaucaacggcaucaccaacaaggucaacagcgugaucgagaagaugaacacccaguucaccgccgucggcaaggaguucaacaagcucgagcgccggauggagaaccugaacaagaagguggacgacggguucaucgacaucuggacguacaacgccgagcugcucgugcugcuggagaacgagcgcacccucgacuuccacgacuccaacgucaagaaccuguacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcucaaccgggagaagaucgacggggugaagcuggagucgaugggcguguaccagauccuggcgaucuacuccaccguggccagcagccucguccugcuggugucccucggcgccaucagcuucuggaugugcuccaacgggagccugcagugccgcaucugcaucuga

SEQ ID NO: 6654 - RNA, 1698 nt, Artificial Sequence
  derived and/or modified CDS sequence (AUadapt) from InfluenzaA__ADW10538__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcgugaugagcucccacuacucgcgcaaguucacccccgagaucgccaagcggcccaaggugcgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcgcagcgccaagcugcggauggucaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacggggugaagcucgaguccaugggcgucuaccagauccuggcgaucuacagcaccguggccagcucccuggugcuccuggucagccugggcgccaucuccuucuggaugugcagcaacgggucccuccagugccgcaucugcaucuga

SEQ ID NO: 6655 - RNA, 1698 nt, Artificial Sequence; identical to SEQ ID NO: 3861
  derived and/or modified CDS sequence (AUadapt) from InfluenzaA__ADW10549__HA

SEQ ID NO: 6656 - RNA, 1698 nt, Artificial Sequence
  derived and/or modified CDS sequence (AUadapt) from InfluenzaA__ADW10560__HA
augaaggugaagcugcucguccugcugugcaccuucaccgccacguacgccgacaccaucugcaucggcuaccacgcgaacaacucgaccgacaccguggacacgguguucgagaagaacgucaccgugacccacuccgugaaccuccuggagaacagccacaacgggaagcugugccuccugaagggcaucgcgccccugcagcucgggaacugcuccgucgccggcuggauccuggggaacccggagugcgagcugcucaucagcaaggaguccuggucguacaucguggagaagcccaaccccgagaacgggaccugcuaccccggccacuucgccgacuacgaggagcugcgcgagcagcuguccagcguguccagcuucgagcgguucgagaucuucccgaaggaguccagcuggcccaaccacacggucaccgggguguccgccucgugcucccacaacggcgagcgcagcuucuaccggaaccuccuguggcugaccgggaagaacggccucuaccccaaccuguccaagagcuacgccaacaacaaggagaaggaggugcugguccucuggggcgugcaccacccgcccgacaucggcgaccagaagacccuguaccacacggagaacgccuacguguccgucgugucgagccacuacucccgcaaguucacccccgagaucgccaagcggcccaaggugcgcgaccaggagggccggaucaacuacuacuggacccugcucgagcccggggacaccaucaucuucgaggccaacggcaaccugaucgcgccgcgcuacgccuucgcccugagccggggguucggcuccggcaucaucaacagcaacgcccccauggacaagugcgacgccaagugccagacgccccagggggcgaucaacuccucgcuccccuuccagaacguccacccggugaccaucggcgagugccccaaguacgugcgcuccgccaagcugcggauggucaccgggcugcgcaacauccccagcauccagucccggggccucuucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacucggucaucgagaagaugaacacccaguucaccgccguggggaaggaguucaacaagcuggagcgccggauggagaaccugaacaagaaggucgacgacggcuucaucgacaucuggacguacaacgccgagcuccuggugcugcucgagaacgagcgcacccuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcuggagagcaugggcgucuaccagauccucgcgaucuacuccaccguggccucgagccuggugcugcucgucucccugggggccaucagcuucuggaugugcuccaacggcagccugcagugccgcaucugcaucuga

SEQ ID NO: 6657 - RNA, 1698 nt, Artificial Sequence; identical to SEQ ID NO: 6198
  derived and/or modified CDS sequence (AUadapt) from InfluenzaA__ADW10571__HA

SEQ ID NO: 6658 - RNA, 1698 nt, Artificial Sequence; identical to SEQ ID NO: 3376
  derived and/or modified CDS sequence (AUadapt) from InfluenzaA__ADW10582__HA

SEQ ID NO: 6659 - RNA, 1698 nt, Artificial Sequence; identical to SEQ ID NO: 3861
  derived and/or modified CDS sequence (AUadapt) from InfluenzaA__ADW10593__HA

SEQ ID NO: 6660 - RNA, 1698 nt, Artificial Sequence; identical to SEQ ID NO: 3861
  derived and/or modified CDS sequence (AUadapt) from InfluenzaA__ADW10604__HA

SEQ ID NO: 6661 - RNA, 1698 nt, Artificial Sequence; identical to SEQ ID NO: 3861
  derived and/or modified CDS sequence (AUadapt) from InfluenzaA__ADW10615__HA

SEQ ID NO: 6662 - RNA, 1698 nt, Artificial Sequence
  derived and/or modified CDS sequence (AUadapt) from InfluenzaA__ADW10626__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccucgaucgucgaccagaagacccuguaccggacggagaacgccuacgugagcguggucuccagccacuacucccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucagccggggguucggcuccgggaucaucaacagcaacgcccccauggacaagugcgacgccaagugccagacgccccgcggcgcgaucaacuccucgcugcccuuccagaacgugcacccggucaccaucggcgagugccccaaguacgugcgguccgccaagcugcgcauggugaccgggcuccggaacauccccagcauccagucccgcggccuguucggggccaucgccggcuucaucgagggcggcuggaccggcauggucgacgggugguacggcuaccaccaccagaacgagcaggggagcggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacucggaggaguccaagcugaaccgcgagaagaucgacggcgugaagcucgagagcauggggguguaccagauccuggcgaucuacagcaccgucgccuccagccuggugcuccuggugucccugggcgccaucagcuucuggaugugcuccaacggcagccuccagugccggaucugcaucuga

SEQ ID NO: 6663 - RNA, 1698 nt, Artificial Sequence
  derived and/or modified CDS sequence (AUadapt) from InfluenzaA__ADW10721__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucaagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagcggacccuguaccacacggagaacgccuacgugucgguggucagcucccacuacagccgcaaguucacccccgagaucgccaagcggcccaaggugcgcaaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggucggccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 6664 - RNA, 1698 nt, Artificial Sequence
  derived and/or modified CDS sequence (AUadapt) from InfluenzaA__ADW10743__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacaccuacgugagcguggucagcucccacuacucgcgcaaguucacccccgagaucgccaagcggcccaagauccgcgaccaggaggggcggaucaacuacuacuggacccuccuggagcccggcgacacgaucaucuucgaggccaacggcaaccugaucgccccgcgcuacgcguucgcccucucccggggguucggcagcgggaucaucaacuccaacgcccccauggacaagugcgacgccaagugccagacgccccgcggcgccaucaacagcucccugcccuuccagaacgugcacccggugaccaucggcgagugccccaaguacguccggagcgugaagcugcgcauggugaccgggcuccggaacauccccuccauccagagccgcggccuguucggggcgaucgccggcuucaucgagggcggcuggaccggcauggucgacgggugguacggcuaccaccaccagaacgagcagggguccggcuacgccgccgaccagaaguccacccagaacgccaucaacgggaucaccaacaaggugaacagcgucaucgagaagaugaacacccaguucacggcggugggcaaggaguucaacaagcuggagcggcgcauggagaaccucaacaagaagguggacgacggcuucaucgacaucuggaccuacaacgccgagcugcugguccuccuggagaacgagcggacccuggacuuccacgacucgaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggccaucuacagcacggucgccagcucccuggugcuccuggugagccugggcgcgaucuccuucuggaugugcagcaacggcucccuccagugccggaucugcaucuga

SEQ ID NO: 6665 - RNA, 1698 nt, Artificial Sequence
  derived and/or modified CDS sequence (AUadapt) from InfluenzaA__ADW10754__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucggugcagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacuccaacgucaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccguggccucgagccugguccuccuggugucccugggcgccaucagcuucuggaugugcuccaacgggagccuccagugccggaucugcaucuga

SEQ ID NO: 6666 - RNA, 1698 nt, Artificial Sequence
  derived and/or modified CDS sequence (AUadapt) from InfluenzaA__ADW10765__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccacacggagaacgccuacgugucgguggucagcucccacuacagccggaaguucacccccgagaucgccaagcgccccaaggugcggaaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccggggcgcgaucaacagcucccugcccuuccagaacgugcacccggucaccaucggcgagugccccaaguacgugcgcucggccaagcugcggauggugaccgggcuccgcaacauccccuccauccagagccggggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgggagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccgcaucugcaucuga

SEQ ID NO: 6667 - RNA, 1698 nt, Artificial Sequence
  derived and/or modified CDS sequence (AUadapt) from InfluenzaA__ADW10776__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacgacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacggggucaagcucgaguccaugggcguguaccagauccuggcgaucuacagcaccguggccagcucccugguccuccuggugagccugggcgccaucuccuucuggaugugcagcaacgggucccuccagugccgcaucugcaucuga

SEQ ID NO: 6668 - RNA, 1698 nt, Artificial Sequence
  derived and/or modified CDS sequence (AUadapt) from InfluenzaA__ADW10787__HA
augaaggugaagauccugguccuccugugcaccuucaccgccacguacgccgacaccaucugcaucggcuaccacgcgaacaacucgaccgacaccguggacacggugcuggagaagaacgucaccgugacccacuccgugaaccuccuggagaacagccacaacgggaagcugugccuccugaagggcaucgcgccccugcagcucgggaacugcuccgucgccggcuggauccuggggaacccggagugcgagcugcucaucagcaaggaguccuggagcuacaucguggagaagcccaaccccgagaacgggaccugcuaccccggccacuucgccgacuacgaggagcugcgcgagcagcuguccagcguguccucguucgagcgguucgagaucuucccgaaggaguccagcuggcccaaccacacggucaccgggguguccgccagcugcucccacaacggcgagagcuccuucuaccgcaaccuccuguggcugaccgugaagaacgggcucuaccccaaccugagcaaguccuacgccaacaacaaggagaaggagguccuggugcucuggggcgugcaccacccgcccaacaucgucgaccagaagacccuguaccggacggagaacgccuacgugucgguggucagcucccacuacagccgcaaguucacccccgagaucgccaagcggcccaaggugcgcgaccaggaggggcggaucaacuacuacuggacccugcucgagcccggcgacaccaucaucuucgaggccaacggcaaccugaucgcgccgcgcuacgccuucgcccugucccggggguucggcagcgggaucaucaacuccaacgcccccauggacaagugcgacgccaagugccagacgccccgcggcgcgaucaacagcucccuccccuuccagaacgugcacccggucaccaucggcgagugccccaaguacgugcggucggccaagcugcgcauggugaccgggcugcggaacauccccuccauccagagccgcggccucuucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccugaacaagaagguggacgacggcuucaucgacaucuggacguacaacgccgagcuccugguccugcucgagaacgagcggacccuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcgugaagcuggaguccauggggguguaccagauccucgcgaucuacagcaccgucgccagcucccuggugcugcucgugagccugggcgccaucuccuucuggaugugcagcaacggcucccugcagugccggaucugcaucuga

SEQ ID NO: 6669 - RNA, 1698 nt, Artificial Sequence
  derived and/or modified CDS sequence (AUadapt) from InfluenzaA__ADW10798__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggguggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgggagaagaucgacggcgugaagcucgaguccaugggcguguaccagauccuggcgaucuacagcaccgucgccagcucccuggugcuccuggugagccugggggccaucuccuucuggaugugcagcaacggcucccuccagugccgcaucugcaucuga

SEQ ID NO: 6670 - RNA, 1698 nt, Artificial Sequence; identical to SEQ ID NO: 6666
  derived and/or modified CDS sequence (AUadapt) from InfluenzaA__ADW10809__HA

SEQ ID NO: 6671 - RNA, 1698 nt, Artificial Sequence; identical to SEQ ID NO: 3861
  derived and/or modified CDS sequence (AUadapt) from InfluenzaA__ADW10820__HA

SEQ ID NO: 6672 - RNA, 1698 nt, Artificial Sequence; identical to SEQ ID NO: 3376
  derived and/or modified CDS sequence (AUadapt) from InfluenzaA__ADW10831__HA

SEQ ID NO: 6673 - RNA, 1698 nt, Artificial Sequence
  derived and/or modified CDS sequence (AUadapt) from InfluenzaA__ADW10842__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugucgguggucagcucccacuacagccgcaaguucgcccccgagaucgccaagcggcccaaggugcgcgaccaggaggggcggaucaacuacuacuggacccuccuggagcccggcgacaccaucaucuucgaggcgaacggcaaccugaucgccccgcgcuacgccuucgcccucucccggggguucggcagcgggaucaucaacuccaacgcccccauggacaagugcgacgcgaagugccagacgccccgcggcgccaucaacagcucccugcccuuccagaacgugcacccggucaccaucggcgagugccccaaguacgugcggucggccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcgugaagcucgaguccauggggguguaccagauccuggccaucuacagcaccgucgccagcucccuggugcuccuggugagccugggcgccaucuccuucuggaugugcagcaacggcucccuccagugccggaucugcaucuga

SEQ ID NO: 6674 - RNA, 1698 nt, Artificial Sequence; identical to SEQ ID NO: 6217
  derived and/or modified CDS sequence (AUadapt) from InfluenzaA__ADW10853__HA

SEQ ID NO: 6675 - RNA, 1698 nt, Artificial Sequence; identical to SEQ ID NO: 6666
  derived and/or modified CDS sequence (AUadapt) from InfluenzaA__ADW10864__HA

SEQ ID NO: 6676 - RNA, 1698 nt, Artificial Sequence; identical to SEQ ID NO: 6666
  derived and/or modified CDS sequence (AUadapt) from InfluenzaA__ADW10875__HA

SEQ ID NO: 6677 - RNA, 1698 nt, Artificial Sequence; identical to SEQ ID NO: 3861
  derived and/or modified CDS sequence (AUadapt) from InfluenzaA__ADW10886__HA

SEQ ID NO: 6678 - RNA, 1698 nt, Artificial Sequence
  derived and/or modified CDS sequence (AUadapt) from InfluenzaA__ADW10897__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacucgcggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacacgaagugccagacgccccagggcgccaucaacagcucccugcccuuccagaacguccacccggugaccaucggggagugccccaaguacgugcggagcgcgaagcugcgcauggucaccggccuccggaacauccccuccauccagucgcgcgggcuguucggcgccaucgccggguucaucgagggcggcuggaccgggaugguggacggcugguacggguaccaccaccagaacgagcagggcuccggguacgccgccgaccagaaguccacccagaacgcgaucaacggcaucaccaacaaggugaacagcgucaucgagaagaugaacacccaguucacggccgugggcaaggaguucaacaagcuggagcggcgcauggagaaccucaacaagaaggucgacgacggguucaucgacaucuggaccuacaacgccgagcugcuggugcuccuggagaacgagcggacccuggacuuccacgacagcaacgugaagaaccucuacgagaaggucaagucccagcugaagaacaacgccaaggaggugggcaacgggugcuucgaguucuaccacaagugcaacgacgagugcauggagagcgugaagaacggcaccuacgacuaccccaaguacuccgaggagucgaagcugaaccgcgagaagaucgacggggucaagcucgagagcaugggcguguaccagauccuggccaucuacuccacgguggcgagcucccugguccuccuggugagccugggcgccaucuccuucuggaugugcagcaacgggucccuccagugccggaucugcaucuga

SEQ ID NO: 6679 - RNA, 1701 nt, Artificial Sequence
  derived and/or modified CDS sequence (AUadapt) from InfluenzaA__ADW23115__HA
augaagaccaucaucgcccugucguacauccucugccugguguucgcccagaagcugcccggcaacgggaacuccaccgcgacgcucugccugggccaccacgccgucccgaacgggaccaucgugaagaccaucaccaacgaccagaucgaggugacgaacgccaccgagcugguccagucguccagcaccggcgagaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcauccgccgguccaacaacucguucuucucccgccugaacuggcucacgcacagcaaguucaaguaccccgcccugaacgugaccaugcccaacaacgagcaguucgacaagcuguacaucuggggcguccaccaccccgggaccgacaacgaccagaucuuccucuacgcgcaggccuccggccggaucaccgugucgacgaagcgcagccagcagaccgugaucccgaacaucggcucccggccccgcguccggaacauccccucgcgcaucuccaucuacuggaccaucgugaagcccggggacauccugcugaucaacagcaccggcaaccucaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggccgggggcaggccgccgaccucaagucgacccaggcggccaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 6680 - RNA, 1701 nt, Artificial Sequence
  derived and/or modified CDS sequence (AUadapt) from InfluenzaA__ADW54481__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 6681 - RNA, 1701 nt, Artificial Sequence
  derived and/or modified CDS sequence (AUadapt) from InfluenzaA__ADW54512__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucaagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccacccgcccacgucggcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 6682 - RNA, 1701 nt, Artificial Sequence
  derived and/or modified CDS sequence (AUadapt) from InfluenzaA__ADW54527__HA
augaaggccauccuggugguccuccuguacaccuucgccaccgcgucggccgacacgcugugcaucggcuaccacgccaacaacuccaccgacaccguggacaccgugcucgagaagaacgucacggugacccacucggugaaccugcuggaggacaagcacaacgggaagcucugcaagcugcgcggcgucgcgccccugcaccucgggaagugcaacaucgccggcuggauccuggggaacccggagugcgagucccugagcaccgccuccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccaccgccugcccgcacgccggcgccaagucguucuacaagaaccugaucuggcucgugaagaaggggaacuccuaccccaagcugagcaagucguacaucaacgacaagggcaaggaggugcugguccucugggggauccaccacccgcccacguccgcggaccagcagagccuguaccagaacgccgacgccuacguguucgugggcaccucccgguacucgaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacaccccggugcacgacugcaacacgaccugccagacccccaacggcgccaucaacaccucccugcccuuccagaacauccaccccaucaccaucgggaagugcccgaaguacgucaagucgaccaagcugcggcucgccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 6683 - RNA, 1701 nt, Artificial Sequence; identical to SEQ ID NO: 6680
  derived and/or modified CDS sequence (AUadapt) from InfluenzaA__ADW65825__HA

SEQ ID NO: 6684 - RNA, 1701 nt, Artificial Sequence
  derived and/or modified CDS sequence (AUadapt) from InfluenzaA__ADW82135__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguacaccgcccugaacgucaccaugcccaacaacgagcaguucgacaagcucuacaucuggggcgugcaccaccccgggaccgacaaggaccagaucuuccuguacgcgcaggccucggggcggaucacgguguccaccaagcgcagccagcagaccgucauccccaacaucggcucgcggccgcgcgugcggaacauccccucccgcaucagcaucuacuggaccaucgugaagcccggcgacauccugcucaucaacuccacggggaaccugaucgcgccccggggcuacuucaagauccgcucggggaaguccucgaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 6685 - RNA, 1701 nt, Artificial Sequence; identical to SEQ ID NO: 6684
  derived and/or modified CDS sequence (AUadapt) from InfluenzaA__ADW82155__HA

SEQ ID NO: 6686 - RNA, 1701 nt, Artificial Sequence; identical to SEQ ID NO: 6684
  derived and/or modified CDS sequence (AUadapt) from InfluenzaA__ADW82166__HA

SEQ ID NO: 6687 - RNA, 1701 nt, Artificial Sequence; identical to SEQ ID NO: 6684
  derived and/or modified CDS sequence (AUadapt) from InfluenzaA__ADW82177__HA

SEQ ID NO: 6688 - RNA, 1701 nt, Artificial Sequence; identical to SEQ ID NO: 116
  derived and/or modified CDS sequence (AUadapt) from InfluenzaA__ADW82188__HA

SEQ ID NO: 6689 - RNA, 1701 nt, Artificial Sequence; identical to SEQ ID NO: 116
  derived and/or modified CDS sequence (AUadapt) from InfluenzaA__ADW82198__HA

SEQ ID NO: 6690 - RNA, 1701 nt, Artificial Sequence; identical to SEQ ID NO: 116
  derived and/or modified CDS sequence (AUadapt) from InfluenzaA__ADW82208__HA

SEQ ID NO: 6691 - RNA, 1701 nt, Artificial Sequence; identical to SEQ ID NO: 116
  derived and/or modified CDS sequence (AUadapt) from InfluenzaA__ADW82218__HA

SEQ ID NO: 6692 - RNA, 1701 nt, Artificial Sequence; identical to SEQ ID NO: 116
  derived and/or modified CDS sequence (AUadapt) from InfluenzaA__ADW82228__HA

SEQ ID NO: 6693 - RNA, 1701 nt, Artificial Sequence; identical to SEQ ID NO: 116
  derived and/or modified CDS sequence (AUadapt) from InfluenzaA__ADW82238__HA

SEQ ID NO: 6694 - RNA, 1701 nt, Artificial Sequence; identical to SEQ ID NO: 116
  derived and/or modified CDS sequence (AUadapt) from InfluenzaA__ADW82248__HA

SEQ ID NO: 6695 - RNA, 1701 nt, Artificial Sequence; identical to SEQ ID NO: 116
  derived and/or modified CDS sequence (AUadapt) from InfluenzaA__ADW82258__HA

SEQ ID NO: 6696 - RNA, 1701 nt, Artificial Sequence
  derived and/or modified CDS sequence (AUadapt) from InfluenzaA__ADW82268__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcauccaccagauccuggcgaucuacuccaccgucgccucgagccuggugcucguggucucccugggggccaucucguucuggaugugcuccaacggcagccugcagugccggaucugcaucuga

SEQ ID NO: 6697 - RNA, 1701 nt, Artificial Sequence; identical to SEQ ID NO: 6684
  derived and/or modified CDS sequence (AUadapt) from InfluenzaA__ADW93760__HA

SEQ ID NO: 6698 - RNA, 1701 nt, Artificial Sequence
  derived and/or modified CDS sequence (AUadapt) from InfluenzaA__ADW95319__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacgagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 6699 - RNA, 1701 nt, Artificial Sequence
  derived and/or modified CDS sequence (AUadapt) from InfluenzaA__ADW95332__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 6700 - RNA, 1701 nt, Artificial Sequence
  derived and/or modified CDS sequence (AUadapt) from InfluenzaA__ADX21078__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguacaccgcccugaacgucaccaugcccaacaacgagcaguucgacaagcucuacaucuggggcgugcaccaccccgggaccgacaaggaccagaucuuccuguacgcgcaggccucggggcggaucacgguguccaccaagcgcagccagcagaccgucauccccaacaucggcucgcggccgcgcgugcggaacauccccucccgcaucagcaucuacuggaccaucgugaagcccggcgacauccugcucaucaacuccacggggaaccugaucgcgccccggggcuacuucaagauccgcucggggaaguccucgaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucauccggaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcguggagcugaaguccggguacaaggacuggauccuguggaucuccuucgccaucagcugcuuccuccugugcgucgcccugcucggcuucaucaugugggccugccagaagggcaacauccgcugcaacaucugcaucuga

SEQ ID NO: 6701 - RNA, 1701 nt, Artificial Sequence; identical to SEQ ID NO: 6700
  derived and/or modified CDS sequence (AUadapt) from InfluenzaA__ADX21088__HA

SEQ ID NO: 6702 - RNA, 1701 nt, Artificial Sequence
  derived and/or modified CDS sequence (AUadapt) from InfluenzaA__ADX21098__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcuccacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcauccaccagauccuggcgaucuacucgaccgucgccagcucccuggugcucguggucucgcugggggccaucuccuucuggaugugcagcaacggcucccugcagugccggaucugcaucuga

SEQ ID NO: 6703 - RNA, 1701 nt, Artificial Sequence; identical to SEQ ID NO: 3833
  derived and/or modified CDS sequence (AUadapt) from InfluenzaA__ADX36109__HA

SEQ ID NO: 6704 - RNA, 1701 nt, Artificial Sequence
  derived and/or modified CDS sequence (AUadapt) from InfluenzaA__ADX96278__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccucgaccagcgccgaccagcagucccucuaccagaacgccgacgccuacguguucgugggcucgucccgguacagcaagaaguucaagcccgagaucgccauccgcccgaagguccgggaccaggaggggcgcaugaacuacuacuggacgcugguggagcccggcgacaagaucaccuucgaggcgaccgggaaccugguggucccccgguacgccuucgccauggagcgcaacgccggcuccggcaucaucaucucggacacccccgugcacgacugcaacacgaccugccagaccccgaagggggccgugaacaccucccuccccuuccagaacauccaccccaucacgaucggcaagugccccaaguacgucaagagcaccaagcugcggcuggcgaccgggcuccgcaacgugccguccauccagucgcggggccuguucggggccaucgccggcuucaucgagggcggguggaccggcaugguggacgggugguacggcuaccaccaccagaacgagcagggguccggcuacgccgccgaccucaagucgacgcagaacgcgaucgacgagaucaccaacaaggucaacuccgugaucgagaagaugaacacccaguucaccgccgucggcaaggaguucaaccaccuggagaagcgcaucgagaaccugaacaagaagguggacgacggguuccuggacaucuggacguacaacgccgagcuccuggugcugcucgagaacgagcggacccuggacuaccacgacagcaacgucaagaaccuguacgagaaggugcgcucccagcucaagaacaacgccaaggaggugggcaacgggugcuucgaguucuaccacaagugcgacaacacgugcauggagucggucaagaacggcaccuacgacuaccccaaguacuccgaggaggccaagcugaaccgggaggagaucgacggggugaagcuggagagcacccgcaucuaccagauccucgcgaucuacuccaccgccgccucgagccuggugcuggucgugucccucggcgccaucucguucuggaugugcuccaacggcagccugcagugccggaucugcaucuga

SEQ ID NO: 6705 - RNA, 1701 nt, Artificial Sequence
  derived and/or modified CDS sequence (AUadapt) from InfluenzaA__ADX96288__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagcaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacucgaccgccgccagcucccuggugcugguggucucgcucggggccaucuccuucuggaugugcagcaacggcucccugcagugccggaucugcaucuga

SEQ ID NO: 6706 - RNA, 1701 nt, Artificial Sequence
  derived and/or modified CDS sequence (AUadapt) from InfluenzaA__ADX96298__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgucauccgcccgaaggugcgggaccaggagggccgcaugaacuacuacuggacccugguggagcccggggacaagaucaccuucgaggccaccggcaaccuggucgugccccgguacgcguucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggccaccggccuccgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccuggacaucuggaccuacaacgccgagcuccuggugcugcucgagaacgagcggacccuggacuaccacgacucgaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagucgacccgcaucuaccagauccucgccaucuacuccaccguggcgagcucgcuggugcuggucgugucccucggggccaucagcuucuggaugugcuccaccggcagccugcagugccggaucugcaucuga

SEQ ID NO: 6707 - RNA, 1701 nt, Artificial Sequence; identical to SEQ ID NO: 4511
  derived and/or modified CDS sequence (AUadapt) from InfluenzaA__ADX96308__HA

SEQ ID NO: 6708 - RNA, 1701 nt, Artificial Sequence
  derived and/or modified CDS sequence (AUadapt) from InfluenzaA__ADX96318__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 6709 - RNA, 1701 nt, Artificial Sequence
  derived and/or modified CDS sequence (AUadapt) from InfluenzaA__ADX96328__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 6710 - RNA, 1701 nt, Artificial Sequence
  derived and/or modified CDS sequence (AUadapt) from InfluenzaA__ADX96347__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6711 - RNA, 1701 nt, Artificial Sequence
  derived and/or modified CDS sequence (AUadapt) from InfluenzaA__ADX96357__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgucauccgcccgaaggugcgggaccaggagggccgcaugaacuacuacuggacccugguggagcccggggacaagaucaccuucgaggccaccggcaaccuggucgugccccgguacgcguucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggccaccggccuccgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccuggacaucuggaccuacaacgccgagcuccuggugcugcucgagaacgagcggacccuggacuaccacgacucgaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagucgacccgcaucuaccagauccucgccaucuacuccaccguggcgagcucgcuggugcuggucgugucccucggggccaucagcuucuggaugugcuccaacggcagccugcagugccggaucugcaucuga

SEQ ID NO: 6712 - RNA, 1701 nt, Artificial Sequence; identical to SEQ ID NO: 5851
  derived and/or modified CDS sequence (AUadapt) from InfluenzaA__ADX96367__HA

SEQ ID NO: 6713 - RNA, 1701 nt, Artificial Sequence
  derived and/or modified CDS sequence (AUadapt) from InfluenzaA__ADX96378__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccauccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6714 - RNA, 1701 nt, Artificial Sequence; identical to SEQ ID NO: 6713
  derived and/or modified CDS sequence (AUadapt) from InfluenzaA__ADX96398__HA

SEQ ID NO: 6715 - RNA, 1701 nt, Artificial Sequence
  derived and/or modified CDS sequence (AUadapt) from InfluenzaA__ADX96408__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccauccacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcuggagagcacccgcaucuaccagauccucgcgaucuacuccaccguggccucgagccugguccugguggugucccucggggccaucucguucuggaugugcuccaacggcagccugcagugccggaucugcaucuga

SEQ ID NO: 6716 - RNA, 1701 nt, Artificial Sequence; identical to SEQ ID NO: 3227
  derived and/or modified CDS sequence (AUadapt) from InfluenzaA__ADX96427__HA

SEQ ID NO: 6717 - RNA, 1701 nt, Artificial Sequence
  derived and/or modified CDS sequence (AUadapt) from InfluenzaA__ADX96437__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgccuggagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccgccgccagcucccuggugcucguggucucgcugggggccaucuccuucuggaugugcagcaacggcucccugcagugccggaucugcaucuga

SEQ ID NO: 6718 - RNA, 1701 nt, Artificial Sequence; identical to SEQ ID NO: 62
  derived and/or modified CDS sequence (AUadapt) from InfluenzaA__ADX96447__HA

SEQ ID NO: 6719 - RNA, 1701 nt, Artificial Sequence; identical to SEQ ID NO: 116
  derived and/or modified CDS sequence (AUadapt) from InfluenzaA__ADX96497__HA

SEQ ID NO: 6720 - RNA, 1701 nt, Artificial Sequence
  derived and/or modified CDS sequence (AUadapt) from InfluenzaA__ADX96507__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaccggcagccugcagugccggaucugcaucuga

SEQ ID NO: 6721 - RNA, 1701 nt, Artificial Sequence; identical to SEQ ID NO: 6720
  derived and/or modified CDS sequence (AUadapt) from InfluenzaA__ADX96517__HA

SEQ ID NO: 6722 - RNA, 1701 nt, Artificial Sequence
  derived and/or modified CDS sequence (AUadapt) from InfluenzaA__ADX96527__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuuccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 6723 - RNA, 1701 nt, Artificial Sequence; identical to SEQ ID NO: 116
  derived and/or modified CDS sequence (AUadapt) from InfluenzaA__ADX96537__HA

SEQ ID NO: 6724 - RNA, 1701 nt, Artificial Sequence; identical to SEQ ID NO: 116
  derived and/or modified CDS sequence (AUadapt) from InfluenzaA__ADX96547__HA

SEQ ID NO: 6725 - RNA, 1701 nt, Artificial Sequence; identical to SEQ ID NO: 4015
  derived and/or modified CDS sequence (AUadapt) from InfluenzaA__ADX96557__HA

SEQ ID NO: 6726 - RNA, 1701 nt, Artificial Sequence; identical to SEQ ID NO: 116
  derived and/or modified CDS sequence (AUadapt) from InfluenzaA__ADX96587__HA

SEQ ID NO: 6727 - RNA, 1701 nt, Artificial Sequence; identical to SEQ ID NO: 62
  derived and/or modified CDS sequence (AUadapt) from InfluenzaA__ADX96597__HA

SEQ ID NO: 6728 - RNA, 1701 nt, Artificial Sequence; identical to SEQ ID NO: 62
  derived and/or modified CDS sequence (AUadapt) from InfluenzaA__ADX96607__HA

SEQ ID NO: 6729 - RNA, 1701 nt, Artificial Sequence
  derived and/or modified CDS sequence (AUadapt) from InfluenzaA__ADX96627__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaccggcagccugcagugccgcaucugcaucuga

SEQ ID NO: 6730 - RNA, 1701 nt, Artificial Sequence; identical to SEQ ID NO: 3361
  derived and/or modified CDS sequence (AUadapt) from InfluenzaA__ADX96637__HA

SEQ ID NO: 6731 - RNA, 1701 nt, Artificial Sequence; identical to SEQ ID NO: 116
  derived and/or modified CDS sequence (AUadapt) from InfluenzaA__ADX96647__HA

SEQ ID NO: 6732 - RNA, 1701 nt, Artificial Sequence; identical to SEQ ID NO: 62
  derived and/or modified CDS sequence (AUadapt) from InfluenzaA__ADX96657__HA

SEQ ID NO: 6733 - RNA, 1701 nt, Artificial Sequence; identical to SEQ ID NO: 116
  derived and/or modified CDS sequence (AUadapt) from InfluenzaA__ADX96667__HA

SEQ ID NO: 6734 - RNA, 1701 nt, Artificial Sequence
  derived and/or modified CDS sequence (AUadapt) from InfluenzaA__ADX96677__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacggugguggagcccggggacaagaucaccuucgaggcgaccggcaaccuggucgugccccgguacgccuucgccauggagcgcaacgccgggucgggcaucaucaucuccgacacccccgugcacgacugcaacacgaccugccagaccccgaagggcgccaucaacaccagccuccccuuccacaacauccaccccaucacgaucgggaagugccccaaguacgucaaguccaccaagcugcggcuggcgaccggccuccgcaacgugccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggucaacucggugaucgagaagaugaacacccaguucaccgccgucggcaaggaguucaaccaccucgagaagcgcaucgagaaccugaacaagaagguggacgacggcuuccuggacaucuggacguacaacgccgagcuccuggugcugcucgagaacgagcggacccuggacuaccacgacuccaacgucaagaaccuguacgagaaggugcgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcuggaguccacccgcaucuaccagauccucgcgaucuacagcaccguggccucgucccuggugcuggucgugagccucggggccaucuccuucuggaugugcagcaacggcucccugcagugccggaucugcaucuga

SEQ ID NO: 6735 - RNA, 1701 nt, Artificial Sequence
  derived and/or modified CDS sequence (AUadapt) from InfluenzaA__ADX96687__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucaagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccguguacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 6736 - RNA, 1701 nt, Artificial Sequence; identical to SEQ ID NO: 116
  derived and/or modified CDS sequence (AUadapt) from InfluenzaA__ADX96697__HA

SEQ ID NO: 6737 - RNA, 1701 nt, Artificial Sequence
  derived and/or modified CDS sequence (AUadapt) from InfluenzaA__ADX96707__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcgacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaccggcagccugcagugccggaucugcaucuga

SEQ ID NO: 6738 - RNA, 1701 nt, Artificial Sequence; identical to SEQ ID NO: 4074
  derived and/or modified CDS sequence (AUadapt) from InfluenzaA__ADX96727__HA

SEQ ID NO: 6739 - RNA, 1701 nt, Artificial Sequence
  derived and/or modified CDS sequence (AUadapt) from InfluenzaA__ADX96737__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaaggucaaggagcaggagggccggaugaacuacuacuggacccugguggagcccggggacaagaucaccuucgaggcgaccggcaaccucguggucccccgcuacgccuucgccauggagcggaaggccggguccggcaucaucaucucggacacgcccgugcacgacugcaacacgaccugccagaccccgaagggcgccaucaacaccucccugcccuuccagaacauccacagcaucaccaucgggaagugccccaaguacgugaaguccaccaagcugcgccucgcgaccggccugcggaacguccccucgauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgcgaggagaucgacggcgugaagcucgaguccacccggaucuaccagauccuggcgaucuacagcaccgucgccucgucccuggugcucgugaucagccugggggccaucuccuucuggaugugcagcaccggcucccugcagugccgcaucugcaucuga

SEQ ID NO: 6740 - RNA, 1701 nt, Artificial Sequence; identical to SEQ ID NO: 116
  derived and/or modified CDS sequence (AUadapt) from InfluenzaA__ADX96747__HA

SEQ ID NO: 6741 - RNA, 1701 nt, Artificial Sequence
  derived and/or modified CDS sequence (AUadapt) from InfluenzaA__ADX96757__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccggcaacggcacgugcuaccccggggacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggcacgucccgguacagcaagaaguucaagcccgagaucgccauccgcccgaagguccgggaccaggaggggcgcaugaacuacuacuggacccugguggugcccggcgacaagaucaccuucgaggcgaccgggaaccucgucgugccccgguacgccuucgccauggagcgcaacgccggcuccggcaucaucaucucggacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagucgacccgcaucuaccagauccuggcgaucuacuccaccguggccagcucgcuggugcucgucgugucccugggcgccaucagcuucuggaugugcuccaccggcagccugcagugccggaucugcaucuga

SEQ ID NO: 6742 - RNA, 1701 nt, Artificial Sequence
  derived and/or modified CDS sequence (AUadapt) from InfluenzaA__ADX96767__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggaguccggggacaagaucaccuucgaggcgaccggcaaccucguggucccccgguacgccuucgccauggagcgcaacgccgggucgggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaagcucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaccggcucccugcagugccggaucugcaucuga

SEQ ID NO: 6743 - RNA, 1701 nt, Artificial Sequence
  derived and/or modified CDS sequence (AUadapt) from InfluenzaA__ADX96777__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggugcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccacucgaucaccaucgggaagugccccaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 6744 - RNA, 1701 nt, Artificial Sequence; identical to SEQ ID NO: 116
  derived and/or modified CDS sequence (AUadapt) from InfluenzaA__ADX96787__HA

SEQ ID NO: 6745 - RNA, 1701 nt, Artificial Sequence; identical to SEQ ID NO: 6141
  derived and/or modified CDS sequence (AUadapt) from InfluenzaA__ADX96797__HA

SEQ ID NO: 6746 - RNA, 1701 nt, Artificial Sequence
  derived and/or modified CDS sequence (AUadapt) from InfluenzaA__ADX96807__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguucuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacucggaggaggccaagcugaaccgggaggagaucgacggcgucaagcuggaguccacccgcaucuaccagauccucgcgaucuacagcaccguggccucgucccuggugcuggucgugagccucggggccaucuccuucuggaugugcagcaacggcucccugcagugccggaucugcaucuga

SEQ ID NO: 6747 - RNA, 1701 nt, Artificial Sequence; identical to SEQ ID NO: 62
  derived and/or modified CDS sequence (AUadapt) from InfluenzaA__ADX96817__HA

SEQ ID NO: 6748 - RNA, 1701 nt, Artificial Sequence
  derived and/or modified CDS sequence (AUadapt) from InfluenzaA__ADX96837__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccguacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacucggaggaggccaagcugaaccgggaggagaucgacggcgucaagcuggaguccacccgcaucuaccagauccucgcgaucuacagcaccguggccucgucccuggugcuggucgugagccucggggccaucuccuucuggaugugcagcaccggcucccugcagugccggaucugcaucuga

SEQ ID NO: 6749 - RNA, 1701 nt, Artificial Sequence; identical to SEQ ID NO: 116
  derived and/or modified CDS sequence (AUadapt) from InfluenzaA__ADX96847__HA

SEQ ID NO: 6750 - RNA, 1701 nt, Artificial Sequence; identical to SEQ ID NO: 116
  derived and/or modified CDS sequence (AUadapt) from InfluenzaA__ADX96857__HA

SEQ ID NO: 6751 - RNA, 1701 nt, Artificial Sequence; identical to SEQ ID NO: 96
  derived and/or modified CDS sequence (AUadapt) from InfluenzaA__ADX96867__HA

SEQ ID NO: 6752 - RNA, 1701 nt, Artificial Sequence; identical to SEQ ID NO: 5851
  derived and/or modified CDS sequence (AUadapt) from InfluenzaA__ADX96877__HA

SEQ ID NO: 6753 - RNA, 1701 nt, Artificial Sequence
  derived and/or modified CDS sequence (AUadapt) from InfluenzaA__ADX96897__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccauccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6754 - RNA, 1701 nt, Artificial Sequence
  derived and/or modified CDS sequence (AUadapt) from InfluenzaA__ADX96907__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacagcgggaagcucugcaagcugcgcggcgucgcgccccugcaccucgggaagugcaacaucgccggcuggauccuggggaacccggagugcgagucccugucgaccgccuccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccagcaagggggucaccgccgccugcccgcacgccggcgcgaaguccuucuacaagaaccugaucuggcucgugaagaaggggaacucguaccccaagcugagcaaguccuacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 6755 - RNA, 1701 nt, Artificial Sequence
  derived and/or modified CDS sequence (AUadapt) from InfluenzaA__ADX96927__HA
augaaggccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccucaucuggcuggucaagaaggggaacucguaccccaagcuguccaagagcuacaucaacgacaagggcaaggaggugcucgugcugugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggaccgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 6756 - RNA, 1701 nt, Artificial Sequence; identical to SEQ ID NO: 4334
  derived and/or modified CDS sequence (AUadapt) from InfluenzaA__ADX96937__HA

SEQ ID NO: 6757 - RNA, 1701 nt, Artificial Sequence; identical to SEQ ID NO: 62
  derived and/or modified CDS sequence (AUadapt) from InfluenzaA__ADX96947__HA

SEQ ID NO: 6758 - RNA, 1701 nt, Artificial Sequence; identical to SEQ ID NO: 4078
  derived and/or modified CDS sequence (AUadapt) from InfluenzaA__ADX96957__HA

SEQ ID NO: 6759 - RNA, 1701 nt, Artificial Sequence; identical to SEQ ID NO: 3227
  derived and/or modified CDS sequence (AUadapt) from InfluenzaA__ADX96967__HA

SEQ ID NO: 6760 - RNA, 1701 nt, Artificial Sequence; identical to SEQ ID NO: 96
  derived and/or modified CDS sequence (AUadapt) from InfluenzaA__ADX96977__HA

SEQ ID NO: 6761 - RNA, 1701 nt, Artificial Sequence
  derived and/or modified CDS sequence (AUadapt) from InfluenzaA__ADX96987__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcaucaagcuggaguccacccgcaucuaccagauccucgcgaucuacagcaccguggccucgucccugguccugguggugagccucggggccaucuccuucuggaugugcagcaacggcucccugcagugccggaucugcaucuga

SEQ ID NO: 6762 - RNA, 1701 nt, Artificial Sequence; identical to SEQ ID NO: 96
  derived and/or modified CDS sequence (AUadapt) from InfluenzaA__ADX96997__HA

SEQ ID NO: 6763 - RNA, 1701 nt, Artificial Sequence
  derived and/or modified CDS sequence (AUadapt) from InfluenzaA__ADX97007__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacgcccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 6764 - RNA, 1701 nt, Artificial Sequence; identical to SEQ ID NO: 6713
  derived and/or modified CDS sequence (AUadapt) from InfluenzaA__ADX97018__HA

SEQ ID NO: 6765 - RNA, 1701 nt, Artificial Sequence
  derived and/or modified CDS sequence (AUadapt) from InfluenzaA__ADX97028__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcuggugaagcaggggaacagcuaccccaagcucuccaagucguacaucaacgacaagggcaaggaggugcugguccugugggggauccaccaccccagcaccacggccgaccagcagucccucuaccagaacgccgacgccuacguguucgugggcucgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagguggggaacggcugcuucgaguucuaccacaagugcgacaacacgugcauggagucggugaagaacgggaccuacgacuaccccaaguacuccgaggaggccaagcugaaccgggaggagaucgacggcgucaagcuggagagcacccgcaucuaccagauccucgcgaucuacuccaccgccgccucgagccuggugcugguggucucccucggggccaucucguucuggaugugcuccaacggcagccugcagugccggaucugcaucuga

SEQ ID NO: 6766 - RNA, 1701 nt, Artificial Sequence; identical to SEQ ID NO: 5467
  derived and/or modified CDS sequence (AUadapt) from InfluenzaA__ADX98640__HA

SEQ ID NO: 6767 - RNA, 1701 nt, Artificial Sequence; identical to SEQ ID NO: 4466
  derived and/or modified CDS sequence (AUadapt) from InfluenzaA__ADX98650__HA

SEQ ID NO: 6768 - RNA, 1701 nt, Artificial Sequence
  derived and/or modified CDS sequence (AUadapt) from InfluenzaA__ADX98665__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucucggacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgccgccucgagccugguccucguggugucccugggcgccaucucguucuggaugugcuccaacggcagccugcagugccggaucugcaucuga

SEQ ID NO: 6769 - RNA, 1701 nt, Artificial Sequence; identical to SEQ ID NO: 4078
  derived and/or modified CDS sequence (AUadapt) from InfluenzaA__ADX98675__HA

SEQ ID NO: 6770 - RNA, 1701 nt, Artificial Sequence; identical to SEQ ID NO: 4078
  derived and/or modified CDS sequence (AUadapt) from InfluenzaA__ADX98695__HA

SEQ ID NO: 6771 - RNA, 1701 nt, Artificial Sequence; identical to SEQ ID NO: 4466
  derived and/or modified CDS sequence (AUadapt) from InfluenzaA__ADX98729__HA

SEQ ID NO: 6772 - RNA, 1701 nt, Artificial Sequence; identical to SEQ ID NO: 5797
  derived and/or modified CDS sequence (AUadapt) from InfluenzaA__ADX98739__HA

SEQ ID NO: 6773 - RNA, 1701 nt, Artificial Sequence; identical to SEQ ID NO: 5546
  derived and/or modified CDS sequence (AUadapt) from InfluenzaA__ADX98748__HA

SEQ ID NO: 6774 - RNA, 1701 nt, Artificial Sequence; identical to SEQ ID NO: 116
  derived and/or modified CDS sequence (AUadapt) from InfluenzaA__ADX98758__HA

SEQ ID NO: 6775 - RNA, 1701 nt, Artificial Sequence; identical to SEQ ID NO: 3267
  derived and/or modified CDS sequence (AUadapt) from InfluenzaA__ADX98767__HA

SEQ ID NO: 6776 - RNA, 1701 nt, Artificial Sequence; identical to SEQ ID NO: 4511
  derived and/or modified CDS sequence (AUadapt) from InfluenzaA__ADX98777__HA

SEQ ID NO: 6777 - RNA, 1701 nt, Artificial Sequence
  derived and/or modified CDS sequence (AUadapt) from InfluenzaA__ADX98785__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcaucgcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggugaccgccgccugcccgcacgccggcgcgaaguccuucuacaagaaccucaucuggcuggucaagaaggggaacagcuaccccaagcuguccaagucguacaucaacgacaagggcaaggaggugcucgugcugugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucggcggggugaagcuggagagcacccgcaucuaccagauccuggcgaucuacuccaccguggccucgagccucguccugguggugucccugggcgccaucucguucuggaugugcuccaacggcagccuccagugccggaucugcaucuga

SEQ ID NO: 6778 - RNA, 1701 nt, Artificial Sequence; identical to SEQ ID NO: 4015
  derived and/or modified CDS sequence (AUadapt) from InfluenzaA__ADX98792__HA

SEQ ID NO: 6779 - RNA, 1701 nt, Artificial Sequence; identical to SEQ ID NO: 4015
  derived and/or modified CDS sequence (AUadapt) from InfluenzaA__ADX98806__HA

SEQ ID NO: 6780 - RNA, 1701 nt, Artificial Sequence; identical to SEQ ID NO: 5955
  derived and/or modified CDS sequence (AUadapt) from InfluenzaA__ADX98818__HA

SEQ ID NO: 6781 - RNA, 1701 nt, Artificial Sequence; identical to SEQ ID NO: 116
  derived and/or modified CDS sequence (AUadapt) from InfluenzaA__ADX98828__HA

SEQ ID NO: 6782 - RNA, 1701 nt, Artificial Sequence; identical to SEQ ID NO: 6305
  derived and/or modified CDS sequence (AUadapt) from InfluenzaA__ADX98843__HA

SEQ ID NO: 6783 - RNA, 1701 nt, Artificial Sequence
  derived and/or modified CDS sequence (AUadapt) from InfluenzaA__ADX98853__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaucgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgccauccgcccgaagguccgggaccaggagggccgcaugaacuaccacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6784 - RNA, 1701 nt, Artificial Sequence; identical to SEQ ID NO: 4078
  derived and/or modified CDS sequence (AUadapt) from InfluenzaA__ADX98860__HA

SEQ ID NO: 6785 - RNA, 1701 nt, Artificial Sequence; identical to SEQ ID NO: 5466
  derived and/or modified CDS sequence (AUadapt) from InfluenzaA__ADX98870__HA

SEQ ID NO: 6786 - RNA, 1701 nt, Artificial Sequence
  derived and/or modified CDS sequence (AUadapt) from InfluenzaA__ADX98880__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccaucaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6787 - RNA, 1701 nt, Artificial Sequence
  derived and/or modified CDS sequence (AUadapt) from InfluenzaA__ADX98890__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgaguccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 6788 - RNA, 1701 nt, Artificial Sequence; identical to SEQ ID NO: 4466
  derived and/or modified CDS sequence (AUadapt) from InfluenzaA__ADX98900__HA

SEQ ID NO: 6789 - RNA, 1701 nt, Artificial Sequence
  derived and/or modified CDS sequence (AUadapt) from InfluenzaA__ADX98910__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaucucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 6790 - RNA, 1701 nt, Artificial Sequence; identical to SEQ ID NO: 4466
  derived and/or modified CDS sequence (AUadapt) from InfluenzaA__ADX98920__HA

SEQ ID NO: 6791 - RNA, 1701 nt, Artificial Sequence; identical to SEQ ID NO: 4078
  derived and/or modified CDS sequence (AUadapt) from InfluenzaA__ADX98930__HA

SEQ ID NO: 6792 - RNA, 1701 nt, Artificial Sequence; identical to SEQ ID NO: 3705
  derived and/or modified CDS sequence (AUadapt) from InfluenzaA__ADX98940__HA

SEQ ID NO: 6793 - RNA, 1701 nt, Artificial Sequence; identical to SEQ ID NO: 5534
  derived and/or modified CDS sequence (AUadapt) from InfluenzaA__ADX98950__HA

SEQ ID NO: 6794 - RNA, 1701 nt, Artificial Sequence; identical to SEQ ID NO: 5515
  derived and/or modified CDS sequence (AUadapt) from InfluenzaA__ADX98960__HA

SEQ ID NO: 6795 - RNA, 1701 nt, Artificial Sequence
  derived and/or modified CDS sequence (AUadapt) from InfluenzaA__ADX98970__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagggccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacaucccgagcauccagucccggggccuguucggggccaucgccggcuucaucgagggcggguggacgggcauggucgacgggugguacggcuaccaccaccagaacgagcaggggucgggcuacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggcgaucuacucgaccguggccuccagccugguccucguggugucgcugggcgccaucuccuucuggaugugcagcaacggcucccugcagugccggaucugcaucuga

SEQ ID NO: 6796 - RNA, 1701 nt, Artificial Sequence; identical to SEQ ID NO: 4015
  derived and/or modified CDS sequence (AUadapt) from InfluenzaA__ADX98980__HA

SEQ ID NO: 6797 - RNA, 1701 nt, Artificial Sequence; identical to SEQ ID NO: 116
  derived and/or modified CDS sequence (AUadapt) from InfluenzaA__ADX98990__HA

SEQ ID NO: 6798 - RNA, 1701 nt, Artificial Sequence; identical to SEQ ID NO: 4078
  derived and/or modified CDS sequence (AUadapt) from InfluenzaA__ADX99000__HA

SEQ ID NO: 6799 - RNA, 1698 nt, Artificial Sequence
  derived and/or modified CDS sequence (AUadapt) from InfluenzaA__ADX99581__HA
augaaggccaaccugcucgugcugcugucggcccucgcggccgccgacgccgacaccaucugcaucggcuaccacgccaacaacuccaccgacacggucgacaccgugcuggagaagaacgugaccgucacccacucggugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacucggagaacggcaucugcuacccgggcgacuucaucgacuacgaggagcuccgcgagcagcuguccagcguguccucguucgagcgguucgagaucuuccccaaggaguccagcuggcccaaccacaacaccaacggggugaccgccgccugcucccacgagggcaagucguccuucuaccgcaaccugcucuggcugaccgagaaggaggggagcuaccccaagcugaagaacuccuacgucaacaagaagggcaaggaggugcucgugcugugggggauccaccacccgcccaacucgaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucggguccggcaucaucacgucgaacgccuccaugcacgagugcaacaccaagugccagacgccccugggcgccaucaacagcucccugcccuaccagaacauccacccggugaccaucggggagugccccaaguacgugcggucggccaagcuccgcauggucaccggccugcggaacacccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucacgaacaaggugaacaccgugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacgcuggacuuccacgacucgaacgucaagaaccuguacgagaaggucaagagccagcucaagaacaacgccaaggagaucggcaacgggugcuucgaguucuaccacaagugcgacaacgagugcauggaguccgugcggaacggcaccuacgacuaccccaaguacucggaggaguccaagcugaaccgcgagaagguggacggggugaagcuggagagcaugggcaucuaccagauccucgccaucuacuccaccgucgccucgucccuggugcugcucgugagccugggcgcgaucucguucuggaugugcuccaacgggagccugcagugccggaucugcaucuga

SEQ ID NO: 6800 - RNA, 1698 nt, Artificial Sequence; identical to SEQ ID NO: 6799
  derived and/or modified CDS sequence (AUadapt) from InfluenzaA__ADX99592__HA

SEQ ID NO: 6801 - RNA, 1698 nt, Artificial Sequence; identical to SEQ ID NO: 6799
  derived and/or modified CDS sequence (AUadapt) from InfluenzaA__ADX99603__HA

SEQ ID NO: 6802 - RNA, 1698 nt, Artificial Sequence
  derived and/or modified CDS sequence (AUadapt) from InfluenzaA__ADX99614__HA
augaaggccaaccugcucgugcugcugucggcccucgcggccgccgacgccgacaccaucugcaucggcuaccacgccaacaacuccaccgacacggucgacaccgugcuggagaagaacgugaccgucacccacucggugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacucggagaacggcaucugcuacccgggcgacuucaucgacuacgaggagcuccgcgagcagcuguccagcguguccucguucgagcgguucgagaucuuccccaaggaguccagcuggcccaaccacaacaccaacggggugaccgccgccugcucccacgagggcaagucguccuucuaccgcaaccugcucuggcugaccgagaagaaggggagcuaccccaagcugaagaacuccuacgucaacaagaagggcaaggaggugcucgugcugugggggauccaccacccgcccaacucgaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucggguccggcaucaucacgucgaacgccuccaugcacgagugcaacaccaagugccagacgccccugggcgccaucaacagcucccugcccuaccagaacauccacccggugaccaucggggagugccccaaguacgugcggucggccaagcuccgcauggucaccggccugcggaacacccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucacgaacaaggugaacaccgugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacgcuggacuuccacgacucgaacgucaagaaccuguacgagaaggucaagagccagcucaagaacaacgccaaggagaucggcaacgggugcuucgaguucuaccacaagugcgacaacgagugcauggaguccgugcggaacggcaccuacgacuaccccaaguacucggaggaguccaagcugaaccgcgagaagguggacggggugaagcuggagagcaugggcaucuaccagauccucgccaucuacuccaccgucgccucgucccuggugcugcucgugagccugggcgcgaucucguucuggaugugcuccaacgggagccugcagugccggaucugcaucuga

SEQ ID NO: 6803 - RNA, 1698 nt, Artificial Sequence
  derived and/or modified CDS sequence (AUadapt) from InfluenzaA__ADX99625__HA
augaaggccaaccugcucgugcugcugucggcccucgcggccgccgacgccgacaccaucugcaucggcuaccacgccaacaacuccaccgacacggucgacaccgugcuggagaagaacgugaccgucacccacucggugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacucggagaacggcaucugcuacccgggcgacuucaucgacuacgaggagcuccgcgagcagcuguccagcguguccucguucgagcgguucgagaucuuccccaaggaguccagcuggcccaaccacaacaccaacggggugaccgccgccugcucccacgagggcaagucguccuucuaccgcaaccugcucuggcugaccgagaaggaggggagcuaccccaagcugaagaacuccuacgucaacaagaagggcaaggaggugcucgugcugugggggauccaccacccgcccaacucgaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucggggccaacggcaaccugaucgcccccauguacgcguucgcccucucgcgcggguucggcuccggcaucaucacgucgaacgccuccaugcacgagugcaacaccaagugccagacgccccugggggccaucaacagcucccugcccuaccagaacauccacccggugaccaucggcgagugccccaaguacgugcggucggccaagcuccgcauggucaccgggcugcggaacacccccuccauccagagccgcggccuguucggggcgaucgccggcuucaucgagggcggguggaccggcaugaucgacgggugguacggcuaccaccaccagaacgagcagggguccggcuacgccgccgaccagaaguccacccagaacgccaucaacggcaucacgaacaaggugaacaccgugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacgcuggacuuccacgacucgaacgucaagaaccuguacgagaaggucaagagccagcucaagaacaacgccaaggagaucgggaacggcugcuucgaguucuaccacaagugcgacaacgagugcauggaguccgugcggaacgggaccuacgacuaccccaaguacucggaggaguccaagcugaaccgcgagaagguggacggcgugaagcuggagagcaugggcaucuaccagauccucgccaucuacuccaccgucgccucgucccuggugcugcucgugagccugggggcgaucucguucuggaugugcuccaacggcagccugcagugccggaucugcaucuga

SEQ ID NO: 6804 - RNA, 1698 nt, Artificial Sequence
  derived and/or modified CDS sequence (AUadapt) from InfluenzaA__ADX99636__HA
augaaggccaaccugcucgugcugcugucggcccucgcggccgccgacgccgacaccaucugcaucggcuaccacgccaacaacuccaccgacacggucgacaccgugcuggagaagaacgugaccgucacccacucggugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacucggagaacggcaucugcuacccgggcgacuucaucgacuacgaggagcuccgcgagcagcuguccagcguguccucguucgagcgguucgagaucuuccccaaggaguccagcuggcccaaccacaacaccaacggggugaccgccgccugcucccacgagggcaagucguccuucuaccgcaaccugcucuggcugaccaagaaggaggggagcuaccccaagcugaagaacuccuacgucaacaagaagggcaaggaggugcucgugcugugggggauccaccacccgcccaacucgaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucggguccggcaucaucacgucgaacgccuccaugcacgagugcaacaccaagugccagacgccccugggcgccaucaacagcucccugcccuaccagaacauccacccggugaccaucggggagugccccaaguacgugcggucggccaagcuccgcauggucaccggccugcggaacacccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucacgaacaaggugaacaccgugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacgcuggacuuccacgacucgaacgucaagaaccuguacgagaaggucaagagccagcucaagaacaacgccaaggagaucggcaacgggugcuucgaguucuaccacaagugcgacaacgagugcauggaguccgugcggaacggcaccuacgacuaccccaaguacucggaggaguccaagcugaaccgcgagaagguggacggggugaagcuggagagcaugggcaucuaccagauccucgccaucuacuccaccgucgccucgucccuggugcugcucgugagccugggcgcgaucucguucuggaugugcuccaacgggagccugcagugccggaucugcaucuga

SEQ ID NO: 6805 - RNA, 1698 nt, Artificial Sequence; identical to SEQ ID NO: 3523
  derived and/or modified CDS sequence (AUadapt) from InfluenzaA__ADX99647__HA

SEQ ID NO: 6806 - RNA, 1698 nt, Artificial Sequence
  derived and/or modified CDS sequence (AUadapt) from InfluenzaA__ADX99680__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggucgaaccacaacaccaacggggugaccgccgccugcucccacgagggcaagagcuccuucuaccgcaaccugcucuggcugaccgagaaggaggggucguaccccaagcugaagaacuccuacgucaacaagaagggcaaggaggugcucgugcugugggggauccaccacccgcccaacagcaaggagcagcagaaccuguaccagaacgagaacgcguacgucuccguggugacgucgaacuacaaccggcgcuucacccccgagaucgccgagcggcccaagguccgcgaccaggccggccggaugaacuacuacuggacccuccugaagcccggcgacaccaucaucuucgaggccaacgggaaccugaucgccccgauguacgcguucgcccucagccgcggcuucggguccggcaucaucacgagcaacgccuccaugcacgagugcaacaccaagugccagacgccccugggcgccaucaacucgucccugcccuaccagaacauccaccccgugaccaucggggagugcccgaaguacgugcggagcgccaagcuccgcauggucaccggccugcggaacauccccuccauccagucgcgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagucgcagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagucgaugggcaucuaccagauccucgccaucuacuccaccgucgccagcucccuggugcugcucgugucgcugggcgcgaucagcuucuggaugugcuccaacgggagccugcagugccggaucugcaucuga

SEQ ID NO: 6807 - RNA, 1698 nt, Artificial Sequence
  derived and/or modified CDS sequence (AUadapt) from InfluenzaA__ADX99702__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcugaagaaguccuacgucaacaagaagggcaaggaggugcucgugcugugggggauccaccacccgcccaacucgaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 6808 - RNA, 1698 nt, Artificial Sequence; identical to SEQ ID NO: 6807
  derived and/or modified CDS sequence (AUadapt) from InfluenzaA__ADX99843__HA

SEQ ID NO: 6809 - RNA, 1698 nt, Artificial Sequence
  derived and/or modified CDS sequence (AUadapt) from InfluenzaA__ADX99854__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccugaagcucaagaacagcuacgucaacaagaagggcaaggaggugcuggugcugugggggauccaccacccgcccaacuccaaggagcagcagaaccucuaccagaacgagaacgcguacgucucgguggugacguccaacuacaaccggcgcuucacccccgagaucgccgagcggcccaagguccgcgaccaggccggccggaugaacuacuacuggacccugcugaagcccggcgacaccaucaucuucgaggccaacgggaaccucaucgccccgauguacgcguucgcccugagccgcggcuucgggucgggcaucaucacguccaacgccagcaugcacgagugcaacaccaagugccagacgccccugggcgccaucaacuccucgcuccccuaccagaacauccaccccgugaccaucggggagugcccgaaguacgugcgguccgccaagcugcgcauggucaccggccugcggaacauccccagcauccagucccgcggccucuucggggcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcuggagaagcggauggagaaccugaacaagaagguggacgacggguuccucgacaucuggaccuacaacgccgagcugcuggugcuccuggagaacgagcgcacccuggacuuccacgacucgaacgucaagaaccucuacgagaaggugaagucccagcugaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcucgaguccaugggcaucuaccagauccuggccaucuacagcaccgucgccuccucgcuggugcuccuggugucccugggcgcgaucagcuucuggaugugcagcaacgggucccugcagugccggaucugcaucuga

SEQ ID NO: 6810 - RNA, 1698 nt, Artificial Sequence
  derived and/or modified CDS sequence (AUadapt) from InfluenzaA__ADX99865__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacucgcacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugucguccgugagcuccuucgagcgguucgagaucuuccccaaggagucguccuggcccaaccacaacaccaacggggugaccgccgccugcagccacgagggcaaguccucguucuaccgcaaccugcucuggcugaccgagaaggagggguccuaccccaagcagaagaacagcuacgucaacaagaagggcaaggaggugcuggugcucugggggauccaccacccgcccaacuccaaggagcagcagaaccuguaccagaacgagaacgcguacgucucgguggugacguccaacuacaaccggcgcuucacccccgagaucgccgagcggcccaagguccgcgaccaggccggccggaugaacuacuacuggacccugcucaagccgggcgacaccaucaucuucgaggccaacgggaaccugaucgcccccauguacgcguucgcccugagccgcggcuucgggucgggcaucaucacguccaacgccagcaugcacgagugcaacaccaagugccagacgccccucggcgccaucaacuccucgcugcccuaccagaacauccacccggugaccaucggggagugccccaaguacgugcgguccgccaagcugcgcauggucaccggccuccggaacauccccagcauccagucccgcgggcuguucggcgcgaucgccggguucaucgagggcggcuggaccgggaugaucgacggcugguacggguaccaccaccagaacgagcagggcucgggguacgccgccgaccagaaguccacccagaacgccaucaacggcaucaccaacaaggugaacacggugaucgagaagaugaacauccaguucaccgcggucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcgacaacgagugcauggagucgguccggaacggcacguacgacuaccccaaguacuccgaggagagcaagcucaaccgcgagaagguggacggggugaagcuggaguccaugggcaucuaccagauccuggccaucuacucgaccgucgccuccagccucgugcugcuggugucccucggcgcgaucucguucuggaugugcagcaacgggucccugcagugccggaucugcaucuga

SEQ ID NO: 6811 - RNA, 1698 nt, Artificial Sequence
  derived and/or modified CDS sequence (AUadapt) from InfluenzaA__ADX99887__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcuggagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggucgaagguccgcgaccaggccggccggaugaacuacuacuggacccuccugaagcccggcgacaccaucaucuucgaggccaacgggaaccugaucgccccgauguacgcguucgcccucagccgcggcuucggguccggcaucaucacgagcaacgccuccaugcacgagugcaacaccaagugccagacgccccugggcgccaucaacucgucccugcccuaccagaacauccaccccgugaccaucggggagugcccgaaguacgugcggagcgccaagcuccgcauggucaccggccugcggaacauccccuccauccagucgcgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagucgcagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagucgaugggcaucuaccagauccucgccaucuacuccaccgucgccagcucccuggugcugcucgugucgcugggcgcgaucagcuucuggaugugcuccaacgggagccugcagugccggaucugcaucuga

SEQ ID NO: 6812 - RNA, 1698 nt, Artificial Sequence
  derived and/or modified CDS sequence (AUadapt) from InfluenzaA__ADX99898__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcugaagaacuacuacgucaacaagaagggcaaggaggugcucgugcugugggggauccaccacccgcccaacucgaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucccgcggcuucgggucgggcaucaucacgagcaacgccuccaugcacgagugcaacaccaagugccagacgccccugggcgccaucaacucgucccugcccuaccagaacauccacccggugaccaucggggagugccccaaguacgugcggagcgccaagcuccgcauggucaccggccugcggaacauccccuccauccagucgcgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagucgcagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagucgaugggcaucuaccagauccucgccaucuacuccaccgucgccagcucccuggugcugcucgugucgcugggcgcgaucuccuucuggaugugcagcaacgggagccugcagugccggaucugcaucuga

SEQ ID NO: 6813 - RNA, 1698 nt, Artificial Sequence
  derived and/or modified CDS sequence (AUadapt) from InfluenzaA__ADX99909__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcugaagaacuucuacgucaacaagaagggcaaggaggugcucgugcugugggggauccaccacccgcccaacagcaaggagcagcagaaccuguaccagaacgagaacgcguacgucuccguggugacgucgaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucccgcggcuucgggagcggcaucaucacgucgaacgccuccaugcacgagugcaacaccaagugccagacgccccugggcgccaucaacagcucccugcccuaccagaacauccacccggugaccaucggggagugccccaaguacgugcggucggccaagcuccgcauggucaccggccugcggaacauccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagucgcagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagucgaugggcaucuaccagauccucgccaucuacuccaccgucgccagcucccuggugcugcucgugucgcugggcgcgaucuccuucuggaugugcagcaacgggagccugcagugccggaucugcaucuga

SEQ ID NO: 6814 - RNA, 1698 nt, Artificial Sequence; identical to SEQ ID NO: 6813
  derived and/or modified CDS sequence (AUadapt) from InfluenzaA__ADX99920__HA

SEQ ID NO: 6815 - RNA, 1698 nt, Artificial Sequence
  derived and/or modified CDS sequence (AUadapt) from InfluenzaA__ADX99931__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcuggagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccggccggcccaagguccgcgaccaggccggccggaugaacuacuacuggacccuccugaagccgggggacaccaucaucuucgaggccaacggcaaccugaucgcccccauguacgcguucgcccucucgcgcggguucggcagcggcaucaucacguccaacgccucgaugcacgagugcaacaccaagugccagacgccccugggggccaucaacuccagccugcccuaccagaacauccacccggugaccaucggcgagugccccaaguacgugcgguccgccaagcuccgcauggucaccgggcugcggaacauccccucgauccagucccgcggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucaccaacaaggugaacacggugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucgggaaccggugcuucgaguucuaccacaagugcgacaacgagugcauggagagcguccgcaacggcacguacgacuaccccaaguacuccgaggagucgaagcugaaccgggagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccgcaucugcaucuga

SEQ ID NO: 6816 - RNA, 1698 nt, Artificial Sequence
  derived and/or modified CDS sequence (AUadapt) from InfluenzaA__ADX99964__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaagcacaacaccaacggggugaccgccgccugcucgcacgagggcaaguccagcuucuaccgcaaccugcucuggcugaccgagaaggagggguccuaccccaagcugaagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 6817 - RNA, 1698 nt, Artificial Sequence
  derived and/or modified CDS sequence (AUadapt) from InfluenzaA__ADX99975__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgcgaccugcucgcacgagggcaaguccagcuucuaccgcaaccugcucuggcugacggagaaggagggguccuaccccgagcugaagaacucguacgucaacaagaagggcaaggaggugcucgugcugugggggauccaccacccgcccaacuccaaggagcagcagaaccuguaccagaacgagaacgccuacgucagcguggugaccuccaacuacaaccggcgcuucacccccgagaucgccgagcggcccaagguccgcgaccaggccggccggaugaacuacuacuggacccuccugaagccgggcgacacgaucaucuucgaggccaacgggaaccugaucgcccccauguacgccuucgcgcucucgcgcggcuucgggagcggcaucaucaccuccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgccaucgcgggguucaucgagggcggcuggaccgggaugaucgacggcugguacggguaccaccaccagaacgagcagggcagcggguacgccgccgaccagaaguccacccagaacgccaucaacggcaucacgaacaaggugaacaccgugaucgagaagaugaacauccaguucaccgccgucggcaaggaguucaacaagcucgagaagcggauggagaaccugaacaagaagguggacgacggguuccuggacaucuggaccuacaacgcggagcuccuggugcugcucgagaacgagcgcacgcuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcaccuacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgccaucagcuucuggaugugcagcaacgggucccugcagugccggaucugcaucuga

SEQ ID NO: 6818 - RNA, 1698 nt, Artificial Sequence
  derived and/or modified CDS sequence (AUadapt) from InfluenzaA__ADX99986__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccgaagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcuggagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 6819 - RNA, 1698 nt, Artificial Sequence
  derived and/or modified CDS sequence (AUadapt) from InfluenzaA__ADX99997__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcuggagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaaguacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 6820 - RNA, 1698 nt, Artificial Sequence
  derived and/or modified CDS sequence (AUadapt) from InfluenzaA__ADY00009__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaagaagggguccuaccccaagcuggagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 6821 - RNA, 1698 nt, Artificial Sequence; identical to SEQ ID NO: 3523
  derived and/or modified CDS sequence (AUadapt) from InfluenzaA__ADY00020__HA

SEQ ID NO: 6822 - RNA, 1698 nt, Artificial Sequence
  derived and/or modified CDS sequence (AUadapt) from InfluenzaA__ADY04727__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaaccugaagaaccuguacgagaaggugaagucccagcucaagaacaacgcgaaggagaucgggaacggcugcuucgaguucuaccacaagugcaacaacgagugcauggagagcgucaagaacggcaccuacgacuaccccaaguacuccgaggagagcaagcugaaccgggagaagaucgacggggugaagcuggaguccaugggcguguaccagauccucgccaucuacagcacggucgccagcucccuggugcugcucgugagccugggggccaucuccuucuggaugugcagcaacggcucccugcagugccgcaucugcaucuga

SEQ ID NO: 6823 - RNA, 1701 nt, Artificial Sequence; identical to SEQ ID NO: 3858
  derived and/or modified CDS sequence (AUadapt) from InfluenzaA__ADY11836__HA

SEQ ID NO: 6824 - RNA, 1701 nt, Artificial Sequence; identical to SEQ ID NO: 3833
  derived and/or modified CDS sequence (AUadapt) from InfluenzaA__ADY17654__HA

SEQ ID NO: 6825 - RNA, 1701 nt, Artificial Sequence
  derived and/or modified CDS sequence (AUadapt) from InfluenzaA__ADY17665__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagucguccagcaccggggagaucugcgacucgccccaccagauccucgacggcaagaacugcacccugaucgacgcccugcucggggacccccagugcgacggcuuccagaacaagaagugggaccuguucgucgagcgcucgaaggccuacuccaacugcuaccccuacgacgugccggacuacgcgagccugcggucccucguggccucguccggcacgcuggaguucaacaacgagagcuucaacuggaccggggucacccaggacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcgggcggaucaccgucuccacgaagcgcucgcagcagaccgccaucccgaacaucggcucgcggccccgcgugcggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 6826 - RNA, 1701 nt, Artificial Sequence; identical to SEQ ID NO: 3858
  derived and/or modified CDS sequence (AUadapt) from InfluenzaA__ADY17676__HA

SEQ ID NO: 6827 - RNA, 1701 nt, Artificial Sequence
  derived and/or modified CDS sequence (AUadapt) from InfluenzaA__ADY17687__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccaggacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcgccgcgcugcucggcuucaucaugugggccugccagaaggggaacauccggugcaacaucugcaucuga

SEQ ID NO: 6828 - RNA, 1701 nt, Artificial Sequence; identical to SEQ ID NO: 3833
  derived and/or modified CDS sequence (AUadapt) from InfluenzaA__ADY17698__HA

SEQ ID NO: 6829 - RNA, 1701 nt, Artificial Sequence
  derived and/or modified CDS sequence (AUadapt) from InfluenzaA__ADY38719__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcaagaacugcacgcugaucgacgcccugcucggggacccccagugcgacggcuuccagaacaagaagugggaccuguucguggagcgcucgaaggccuacuccaacugcuaccccuacgacgugccggacuacgccagccugcggucccucgucgcgucguccggcacccuggaguucaacaacgagagcuucaacuggaccggggugacccagaacggcacguccucggccugcauccgccgguccaagaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcgagcgggcggaucacgguguccaccaagcgcucgcagcagaccgccaucccgaacaucggcucgcggccccgcgugcggaacauccccucccgcaucagcaucuacuggaccaucgucaagcccggcgacauccugcucaucaacuccacggggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucaccuacggggccugcccccgguacgugaagcagaacacccugaagcucgcgacgggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 6830 - RNA, 1701 nt, Artificial Sequence; identical to SEQ ID NO: 116
  derived and/or modified CDS sequence (AUadapt) from InfluenzaA__ADY38750__HA

SEQ ID NO: 6831 - RNA, 1701 nt, Artificial Sequence; identical to SEQ ID NO: 4078
  derived and/or modified CDS sequence (AUadapt) from InfluenzaA__ADY38760__HA

SEQ ID NO: 6832 - RNA, 1701 nt, Artificial Sequence
  derived and/or modified CDS sequence (AUadapt) from InfluenzaA__ADZ04607__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcgucuaccagauccuggcgaucuacuccaccguggccucgagccuggugcucgucgugucccugggggccaucucguucuggaugugcuccaacggcagccugcagugccggaucugcaucuga

SEQ ID NO: 6833 - RNA, 1698 nt, Artificial Sequence; identical to SEQ ID NO: 6208
  derived and/or modified CDS sequence (AUadapt) from InfluenzaA__ADZ05834__HA

SEQ ID NO: 6834 - RNA, 1698 nt, Artificial Sequence
  derived and/or modified CDS sequence (AUadapt) from InfluenzaA__ADZ05845__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacauggccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccucgagccuggugcuccuggucucccugggcgccaucagcuucuggaugugcuccaacgggagccuccagugccggaucugcaucuga

SEQ ID NO: 6835 - RNA, 1701 nt, Artificial Sequence; identical to SEQ ID NO: 2679
  derived and/or modified CDS sequence (AUadapt) from InfluenzaA__ADZ05855__HA

SEQ ID NO: 6836 - RNA, 1701 nt, Artificial Sequence
  derived and/or modified CDS sequence (AUadapt) from InfluenzaA__ADZ47838__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccucguccuggagcuacaucguggagaccuccucguccgacaacggcacgugcuaccccggcgacuucaucgacuacgaggagcugcgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccucguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccugcccuuccagaacauccacagcaucaccaucgggaagugccccaaguacgugaaguccaccaagcuccggcuggcgaccggccugcgcaacguccccucgauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcucaaccgggaggagaucgacggcgugaagcuggaguccacccgcaucuaccagauccuggcgaucuacagcaccgucgccucguccuucgugcucaucgugagccugggggccaucuccuucuggaugugcagcaacggcucccugcagugccggaucugcaucuga

SEQ ID NO: 6837 - RNA, 1701 nt, Artificial Sequence; identical to SEQ ID NO: 4086
  derived and/or modified CDS sequence (AUadapt) from InfluenzaA__ADZ47858__HA

SEQ ID NO: 6838 - RNA, 1698 nt, Artificial Sequence
  derived and/or modified CDS sequence (AUadapt) from InfluenzaA__ADZ53100__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggagaccugguccuacaucguggagaagcccaaccccgagaacggcacgugcuaccccggccacuucgccgacuacgaggagcugcgcgagcagcucucguccgugagcuccuucgagcgguucgagaucuucccgaaggagagcuccuggcccaaccacaccgucaccggggugagcgccuccugcucgcacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccuccaucaacgaccagaagacgcuguaccacaccgagaacgccuacgugucggucgugagcucccacuacagccggaaguucacccccgagaucgccaagcgccccaaggugcgggaccaggaggggcgcaucaacuacuacuggacccuccuggagccccgggacacgaucaucuucgaggccaacggcaaccugaucgcgccgcgcuacgccuucgcccucucccggggguucggcagcgggaucaucaacuccaacgcccccauggacaagugcgacgccaagugccagacgccccagggcgcgaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacgggaucaccaacaaggugaacucggucaucgagaagaugaacacccaguucacggccgugggcaaggaguucaacaagcuggagcgccggauggagaaccucaacaagaaggucgacgacggcuucaucgacaucuggaccuacaacgccgagcugcuggugcuccuggagaacgagcgcacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggggucuaccagauccuggcgaucuacucgacgguggccagcucccuggugcuccuggucagccugggcgccaucuccuucuggaugugcagcaacggcucccuccagugccgcaucugcaucuga

SEQ ID NO: 6839 - RNA, 1701 nt, Artificial Sequence; identical to SEQ ID NO: 3361
  derived and/or modified CDS sequence (AUadapt) from InfluenzaA__ADZ53123__HA

SEQ ID NO: 6840 - RNA, 1701 nt, Artificial Sequence; identical to SEQ ID NO: 3156
  derived and/or modified CDS sequence (AUadapt) from InfluenzaA__ADZ53125__HA

SEQ ID NO: 6841 - RNA, 1701 nt, Artificial Sequence; identical to SEQ ID NO: 3538
  derived and/or modified CDS sequence (AUadapt) from InfluenzaA__ADZ53127__HA

SEQ ID NO: 6842 - RNA, 1701 nt, Artificial Sequence; identical to SEQ ID NO: 62
  derived and/or modified CDS sequence (AUadapt) from InfluenzaA__ADZ53131__HA

SEQ ID NO: 6843 - RNA, 1701 nt, Artificial Sequence; identical to SEQ ID NO: 116
  derived and/or modified CDS sequence (AUadapt) from InfluenzaA__ADZ53133__HA

SEQ ID NO: 6844 - RNA, 1701 nt, Artificial Sequence; identical to SEQ ID NO: 3156
  derived and/or modified CDS sequence (AUadapt) from InfluenzaA__ADZ53135__HA

SEQ ID NO: 6845 - RNA, 1701 nt, Artificial Sequence; identical to SEQ ID NO: 4078
  derived and/or modified CDS sequence (AUadapt) from InfluenzaA__ADZ53138__HA

SEQ ID NO: 6846 - RNA, 1701 nt, Artificial Sequence; identical to SEQ ID NO: 116
  derived and/or modified CDS sequence (AUadapt) from InfluenzaA__ADZ53140__HA

SEQ ID NO: 6847 - RNA, 1701 nt, Artificial Sequence; identical to SEQ ID NO: 3361
  derived and/or modified CDS sequence (AUadapt) from InfluenzaA__ADZ93496__HA

SEQ ID NO: 6848 - RNA, 1689 nt, Artificial Sequence; identical to SEQ ID NO: 2595
  derived and/or modified CDS sequence (AUadapt) from InfluenzaA__AEA04365__HA

SEQ ID NO: 6849 - RNA, 1689 nt, Artificial Sequence
  derived and/or modified CDS sequence (AUadapt) from InfluenzaA__AEA04376__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucagcggcaaccccuccuucuuccgcaacaugguguggcugacggagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccgagaucgccacgcggcccaaggugaacggccagggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucgagaacugcgagaccaagugccagaccccgcugggcgccaucaacacgacccugcccuuccacaacgugcacccccucaccaucggggagugccccaaguacgucaagucggagaagcuggugcuggcgaccggccuccgcaacgugccgcagaucgagucccgggggcuguucggcgccaucgccggguucaucgagggcggcuggcaggggauggucgacggcugguacggguaccaccacucgaacgaccagggcuccggguacgccgccgacaaggagucgacgcagaaggcguucgacggcaucaccaacaaggugaacuccgugaucgagaagaugaacacccaguucgaggccgucggcaaggaguucagcaaccuggagcgccggcucgagaaccugaacaagaagguggaggacggguuccuggacguguggaccuacaacgccgagcuccugguccugauggagaacgagcgcacgcucgacuuccacgacuccaacgugaagaaccuguacgacaagguccggaugcagcugcgcgacaacgugaaggagcucggcaacgggugcuucgaguucuaccacaagugcgacgacgagugcaugaacucggugaagaacggcaccuacgacuaccccaaguacgaggaggaguccaagcugaaccggaacgagaucaagggcgucaagcugucguccauggggguguaccagauccucgccaucuacgccaccguggcgggcucgcugucccuggccaucaugauggccgggaucucguucuggaugugcuccaacggcagccuccagugccgcaucugcaucuga

SEQ ID NO: 6850 - RNA, 1698 nt, Artificial Sequence
  derived and/or modified CDS sequence (AUadapt) from InfluenzaA__AEA10292__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugcucccugaagggcaucgcgccccugcagcucgggaacugcagcgucgccggcuggauccuggggaacccggagugcgagcugcucaucuccaaggagagcugguccuacaucguggagaagcccaaccccgagaacgggaccugcuaccccggccacuucgccgacuacgaggagcugcgcgagcagcugucguccgugagcuccuucgagcgguucgagaucuucccgaaggagagcuccuggcccaaccacacggucaccggggugagcgccuccugcucgcacaacggcgaguccagcuucuaccgcaaccuccuguggcugaccgugaagaacgggcucuaccccaaccuguccaagagcuacgccaacaacaaggagaaggagguccuggugcucuggggcgugcaccacccgcccaacaucgucgaccagaagacccuguaccggacggagaacgccuacgugagcguggucuccagccacuacucccgcaaguucacccccgagaucgccaagcggcccaaggugcgcgaccaggaggggcggaucaacuacuacuggacccugcucgagcccggcgacaccaucaucuucgaggccaacggcaaccugaucgcgccgcgcuacgccuucgcccugucgcggggguucggcuccgggaucaucaacagcaacgcccccauggacaagugcgacgccaagugccagacgccccgcggcgcgaucaacuccagccuccccuuccagaacgugcacccggucaccaucggcgagugccccaaguacgugcgguccgccaagcugcgcauggugaccgggcugcggaacauccccagcauccagucccgcggccucuucggggccaucgccggcuucaucgagggcggcuggaccggcauggucgacgggugguacggcuaccaccaccagaacgagcaggggucgggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccugaacaagaagguggacgacggcuucaucgacaucuggacguacaacgccgagcuccugguccugcucgagaacgagcggacccuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcuggagucgauggggguguaccagauccucgcgaucuacagcaccgucgccuccagccuggugcugcucgugucccugggcgccaucagcuucuggaugugcuccaacggcagccugcagugccggaucugcaucuga

SEQ ID NO: 6851 - RNA, 1701 nt, Artificial Sequence; identical to SEQ ID NO: 5513
  derived and/or modified CDS sequence (AUadapt) from InfluenzaA__AEA10303__HA

SEQ ID NO: 6852 - RNA, 1701 nt, Artificial Sequence; identical to SEQ ID NO: 6367
  derived and/or modified CDS sequence (AUadapt) from InfluenzaA__AEA10313__HA

SEQ ID NO: 6853 - RNA, 1701 nt, Artificial Sequence; identical to SEQ ID NO: 4078
  derived and/or modified CDS sequence (AUadapt) from InfluenzaA__AEA10323__HA

SEQ ID NO: 6854 - RNA, 1701 nt, Artificial Sequence; identical to SEQ ID NO: 4466
  derived and/or modified CDS sequence (AUadapt) from InfluenzaA__AEA10339__HA

SEQ ID NO: 6855 - RNA, 1701 nt, Artificial Sequence
  derived and/or modified CDS sequence (AUadapt) from InfluenzaA__AEA10349__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6856 - RNA, 1701 nt, Artificial Sequence; identical to SEQ ID NO: 4511
  derived and/or modified CDS sequence (AUadapt) from InfluenzaA__AEA30293__HA

SEQ ID NO: 6857 - RNA, 1701 nt, Artificial Sequence
  derived and/or modified CDS sequence (AUadapt) from InfluenzaA__AEA48989__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgagagcaacaagggggucaccgccgccugcccgcacgccggcgcgcgguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 6858 - RNA, 1707 nt, Artificial Sequence
  derived and/or modified CDS sequence (AUadapt) from InfluenzaA__AEA50985__HA
auggagaagaucgugcugcuccuggccaucaucaaccuggucaagucggaccagaucugcaucggcuaccacgccaacaacuccaccgagcaggucgacaccaucauggagaagaacgugacggugacccacgcgcaggacauccucgagaagacccacaacgggaagcugugcgaccuggacggcgugaagccccucauccugcgcgacugcagcguggccggguggcugcucggcaacccgaugugcgacgaguuccugaacguccccgagugguccuacaucguggagaagaucaaccccgccaacgaccugugcuaccccgggaacuucaacgacuacgaggagcucaagcaccuccugucgcggaucaaccacuucgagaagauccagaucaucccgaaguccagcugguccgaccacgaggccucguccggcgugagcuccgccugccccuaccagggccgcucguccuucuuccggaacgucguguggcugaucaagaagaacgacgcguaccccaccaucaagaucagcuacaacaacacgaaccaggaggaccugcuggugcucugggggauccaccaccccaacgacgccgccgagcagaccaagcuguaccagaacccgaccaccuacaucuccgucggcacgucgacccugaaccuccgccuggugcccaagaucgccacccgguccaaggugaacgggcagagcggccgcauggaguucuucuggaccauccugaagcccaacgacgcgaucaacuucgaguccaacgggaacuucaucgcccccgagaacgccuacaagaucgucaagaagggcgacucgacgaucaugaaguccgagcucgaguacggcaacugcaacaccaagugccagaccccggugggggccaucaacagcucgaugcccuuccacaacauccacccccugaccaucggcgagugccccaaguacgugaaguccaaccggcugguccucgccacggggcugcgcaacagcccgcagggcgagcggcgccggaagaagcgcggccuguucggggcgaucgccggcuucaucgagggcggguggcaggggaugguggacggcugguacggcuaccaccacuccaacgagcaggggucgggcuacgccgccgacaaggaguccacccagaaggccaucaacggggugaccaacaaggucaacagcaucaucgacaagaugaacacccaguucgaggcggugggccgggaguucaacaaccucgagcgccggaucgagaaccugaacaagaagauggaggacggguuccuggacguguggacguacaacgccgagcuccugguccugauggagaacgagcgcacccucgacuuccacgacuccaacgugaagaaccuguacgacaagguccggcugcagcuccgcgacaacgccaaggagcugggcaacggcugcuucgaguucuaccaccggugcgacaacgagugcauggagucggugcgcaacgggaccuacgacuacccccaguacuccgaggagagccggcugaagcgcgaggagaucuccggcgugaagcucgagucgaucgggaucuaccagauccuguccaucuacagcaccgccgccuccucgcuggcgcucgccaucauggucgccggccugucccuguggaugugcagcaacgggagccuccagugccgcaucugcaucuga

SEQ ID NO: 6859 - RNA, 1701 nt, Artificial Sequence; identical to SEQ ID NO: 5778
  derived and/or modified CDS sequence (AUadapt) from InfluenzaA__AEA72704__HA

SEQ ID NO: 6860 - RNA, 1701 nt, Artificial Sequence; identical to SEQ ID NO: 5778
  derived and/or modified CDS sequence (AUadapt) from InfluenzaA__AEA72715__HA

SEQ ID NO: 6861 - RNA, 1701 nt, Artificial Sequence; identical to SEQ ID NO: 5778
  derived and/or modified CDS sequence (AUadapt) from InfluenzaA__AEA72726__HA

SEQ ID NO: 6862 - RNA, 1701 nt, Artificial Sequence
  derived and/or modified CDS sequence (AUadapt) from InfluenzaA__AEA72740__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacucgaagaaguucaagcccgagaucgccacccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 6863 - RNA, 1701 nt, Artificial Sequence
  derived and/or modified CDS sequence (AUadapt) from InfluenzaA__AEA72750__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcguguucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccacggccgaccagcagucccuguaccagaacgccgacaccuacguguucgucggcaccucgcgguacuccaagaaguucaagcccgagaucgccauccgcccgaaggugcgggaccaggagggccgcaugaacuacuacuggacccugguggagcccggggacaagaucacguucgaggccaccggcaaccucgucgugccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgucaaguccacgaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggucaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggccaucuacuccaccguggcgucgucccuggugcucgucgugagccugggggccaucucguucuggaugugcuccaacggcagccugcagugccggaucugcaucuga

SEQ ID NO: 6864 - RNA, 1701 nt, Artificial Sequence; identical to SEQ ID NO: 6680
  derived and/or modified CDS sequence (AUadapt) from InfluenzaA__AEA72759__HA

SEQ ID NO: 6865 - RNA, 1701 nt, Artificial Sequence
  derived and/or modified CDS sequence (AUadapt) from InfluenzaA__AEA72777__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacgacgggaagcugugcaagcugcgcggcgucgcgccccuccaccuggggaagugcaacaucgccggcuggauccuggggaacccggagugcgagucgcucuccaccgccagcuccuggucguacaucguggagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggagauccucgugcugugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucucggacacgcccguccacgacugcaacgcgaccugccagaccccgaagggcgccaucaacaccucccugcccuuccagaacauccaccccaucacgaucgggaagugccccaaguacgucaagagcaccaagcuccggcuggccaccggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagucgacgcagaacgccaucgacaagaucaccaacaaggugaacuccgugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcucaaccgggaggagaucgacggcgugaagcuggagagcacccgcaucuaccagauccuggccaucuacuccaccguggccucgagccucguccugguggugucccugggggccaucucguucuggaugugcuccaacggcagccuccagugccggaucugcaucuga

SEQ ID NO: 6866 - RNA, 1701 nt, Artificial Sequence; identical to SEQ ID NO: 6680
  derived and/or modified CDS sequence (AUadapt) from InfluenzaA__AEA72787__HA

SEQ ID NO: 6867 - RNA, 1701 nt, Artificial Sequence; identical to SEQ ID NO: 5778
  derived and/or modified CDS sequence (AUadapt) from InfluenzaA__AEA73288__HA

SEQ ID NO: 6868 - RNA, 1701 nt, Artificial Sequence; identical to SEQ ID NO: 5778
  derived and/or modified CDS sequence (AUadapt) from InfluenzaA__AEA73299__HA

SEQ ID NO: 6869 - RNA, 1701 nt, Artificial Sequence; identical to SEQ ID NO: 5778
  derived and/or modified CDS sequence (AUadapt) from InfluenzaA__AEA73310__HA

SEQ ID NO: 6870 - RNA, 1701 nt, Artificial Sequence
  derived and/or modified CDS sequence (AUadapt) from InfluenzaA__AEA73321__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagucgacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccuggugacccuggagaaccagcacacgaucgaccucaccgacuccgagaugaacaagcuguucgagaagaccaagaagcagcugcgcgagaacgccgaggacauggggaacggcugcuucaccaucuaccacaagugcgacaacgcgugcaucgggucgauccgcaacggcacguacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 6871 - RNA, 1701 nt, Artificial Sequence; identical to SEQ ID NO: 5778
  derived and/or modified CDS sequence (AUadapt) from InfluenzaA__AEA73332__HA

SEQ ID NO: 6872 - RNA, 1701 nt, Artificial Sequence; identical to SEQ ID NO: 5778
  derived and/or modified CDS sequence (AUadapt) from InfluenzaA__AEA73343__HA

SEQ ID NO: 6873 - RNA, 1701 nt, Artificial Sequence; identical to SEQ ID NO: 5778
  derived and/or modified CDS sequence (AUadapt) from InfluenzaA__AEA73354__HA

SEQ ID NO: 6874 - RNA, 1701 nt, Artificial Sequence
  derived and/or modified CDS sequence (AUadapt) from InfluenzaA__AEA73365__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacccuggaguucaacaacgagucguucaacuggaccggggugacccagaacggcacguccucggccugcauccgccgguccaacaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucacgguguccaccaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggcgugcccccgguacgucaagcagucgacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgcggaccugaaguccacccaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaccaucuaccacaagugcgacaacgccugcaucgggucgauccgcaacggcacguacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 6875 - RNA, 1701 nt, Artificial Sequence; identical to SEQ ID NO: 5778
  derived and/or modified CDS sequence (AUadapt) from InfluenzaA__AEA73376__HA

SEQ ID NO: 6876 - RNA, 1701 nt, Artificial Sequence; identical to SEQ ID NO: 5778
  derived and/or modified CDS sequence (AUadapt) from InfluenzaA__AEA73387__HA

SEQ ID NO: 6877 - RNA, 1701 nt, Artificial Sequence; identical to SEQ ID NO: 5778
  derived and/or modified CDS sequence (AUadapt) from InfluenzaA__AEA73398__HA

SEQ ID NO: 6878 - RNA, 1701 nt, Artificial Sequence; identical to SEQ ID NO: 5778
  derived and/or modified CDS sequence (AUadapt) from InfluenzaA__AEA73409__HA

SEQ ID NO: 6879 - RNA, 1701 nt, Artificial Sequence; identical to SEQ ID NO: 5778
  derived and/or modified CDS sequence (AUadapt) from InfluenzaA__AEA73420__HA

SEQ ID NO: 6880 - RNA, 1701 nt, Artificial Sequence; identical to SEQ ID NO: 5778
  derived and/or modified CDS sequence (AUadapt) from InfluenzaA__AEA73452__HA

SEQ ID NO: 6881 - RNA, 1701 nt, Artificial Sequence; identical to SEQ ID NO: 5778
  derived and/or modified CDS sequence (AUadapt) from InfluenzaA__AEA73463__HA

SEQ ID NO: 6882 - RNA, 1701 nt, Artificial Sequence; identical to SEQ ID NO: 5778
  derived and/or modified CDS sequence (AUadapt) from InfluenzaA__AEA73474__HA

SEQ ID NO: 6883 - RNA, 1701 nt, Artificial Sequence
  derived and/or modified CDS sequence (AUadapt) from InfluenzaA__AEA73485__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagucgacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaccaucuaccacaagugcgacaacgccugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 6884 - RNA, 1701 nt, Artificial Sequence; identical to SEQ ID NO: 5778
  derived and/or modified CDS sequence (AUadapt) from InfluenzaA__AEA73496__HA

SEQ ID NO: 6885 - RNA, 1701 nt, Artificial Sequence; identical to SEQ ID NO: 5778
  derived and/or modified CDS sequence (AUadapt) from InfluenzaA__AEA73507__HA

SEQ ID NO: 6886 - RNA, 1701 nt, Artificial Sequence; identical to SEQ ID NO: 5778
  derived and/or modified CDS sequence (AUadapt) from InfluenzaA__AEA73518__HA

SEQ ID NO: 6887 - RNA, 1701 nt, Artificial Sequence; identical to SEQ ID NO: 5778
  derived and/or modified CDS sequence (AUadapt) from InfluenzaA__AEA73529__HA

SEQ ID NO: 6888 - RNA, 1701 nt, Artificial Sequence; identical to SEQ ID NO: 5778
  derived and/or modified CDS sequence (AUadapt) from InfluenzaA__AEA73540__HA

SEQ ID NO: 6889 - RNA, 1701 nt, Artificial Sequence; identical to SEQ ID NO: 5778
  derived and/or modified CDS sequence (AUadapt) from InfluenzaA__AEA73551__HA

SEQ ID NO: 6890 - RNA, 1701 nt, Artificial Sequence; identical to SEQ ID NO: 5778
  derived and/or modified CDS sequence (AUadapt) from InfluenzaA__AEA73562__HA

SEQ ID NO: 6891 - RNA, 1698 nt, Artificial Sequence
  derived and/or modified CDS sequence (AUadapt) from InfluenzaA__AEA73573__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccucgugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccaacaucggggaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggcgaucuacucgaccguggccagcucccuggugcuccuggucagccugggcgccaucuccuucuggaugugcagcaacgggucccuccagugccggaucugcaucuga

SEQ ID NO: 6892 - RNA, 1698 nt, Artificial Sequence
  derived and/or modified CDS sequence (AUadapt) from InfluenzaA__AEA73584__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcaaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacggggucaagcucgaguccaugggcguguaccagauccuggcgaucuacagcaccguggccagcucccugguccuccuggugagccugggcgccaucuccuucuggaugugcagcaacgggucccuccagugccgcaucugcaucuga

SEQ ID NO: 6893 - RNA, 1698 nt, Artificial Sequence
  derived and/or modified CDS sequence (AUadapt) from InfluenzaA__AEA73595__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccacacggagaacgccuacgugucgguggucagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccggggcgcgaucaacagcucccugcccuuccagaacgugcacccggucaccaucggcgagugccccaaguacgugcgcucggccaagcugcggauggugaccgggcuccgcaacauccccuccauccagagccggggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgggagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccgcaucugcaucuga

SEQ ID NO: 6894 - RNA, 1698 nt, Artificial Sequence; identical to SEQ ID NO: 6198
  derived and/or modified CDS sequence (AUadapt) from InfluenzaA__AEA73606__HA

SEQ ID NO: 6895 - RNA, 1698 nt, Artificial Sequence; identical to SEQ ID NO: 3376
  derived and/or modified CDS sequence (AUadapt) from InfluenzaA__AEA73617__HA

SEQ ID NO: 6896 - RNA, 1698 nt, Artificial Sequence; identical to SEQ ID NO: 3861
  derived and/or modified CDS sequence (AUadapt) from InfluenzaA__AEA73628__HA

SEQ ID NO: 6897 - RNA, 1698 nt, Artificial Sequence; identical to SEQ ID NO: 6217
  derived and/or modified CDS sequence (AUadapt) from InfluenzaA__AEA73639__HA

SEQ ID NO: 6898 - RNA, 1698 nt, Artificial Sequence; identical to SEQ ID NO: 3376
  derived and/or modified CDS sequence (AUadapt) from InfluenzaA__AEA73650__HA

SEQ ID NO: 6899 - RNA, 1698 nt, Artificial Sequence; identical to SEQ ID NO: 3861
  derived and/or modified CDS sequence (AUadapt) from InfluenzaA__AEA73661__HA

SEQ ID NO: 6900 - RNA, 1698 nt, Artificial Sequence
  derived and/or modified CDS sequence (AUadapt) from InfluenzaA__AEA73672__HA
augaaggugaagcugcucguccugcugugcaccuucaccgccacguucgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacucgcgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacucgaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 6901 - RNA, 1698 nt, Artificial Sequence; identical to SEQ ID NO: 3861
  derived and/or modified CDS sequence (AUadapt) from InfluenzaA__AEA73683__HA

SEQ ID NO: 6902 - RNA, 1698 nt, Artificial Sequence
  derived and/or modified CDS sequence (AUadapt) from InfluenzaA__AEA73694__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugucgguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggucggccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcguggagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 6903 - RNA, 1698 nt, Artificial Sequence; identical to SEQ ID NO: 3861
  derived and/or modified CDS sequence (AUadapt) from InfluenzaA__AEA73705__HA

SEQ ID NO: 6904 - RNA, 1698 nt, Artificial Sequence; identical to SEQ ID NO: 3376
  derived and/or modified CDS sequence (AUadapt) from InfluenzaA__AEA73716__HA

SEQ ID NO: 6905 - RNA, 1698 nt, Artificial Sequence; identical to SEQ ID NO: 3376
  derived and/or modified CDS sequence (AUadapt) from InfluenzaA__AEA73727__HA

SEQ ID NO: 6906 - RNA, 1698 nt, Artificial Sequence; identical to SEQ ID NO: 3376
  derived and/or modified CDS sequence (AUadapt) from InfluenzaA__AEA73738__HA

SEQ ID NO: 6907 - RNA, 1698 nt, Artificial Sequence; identical to SEQ ID NO: 3376
  derived and/or modified CDS sequence (AUadapt) from InfluenzaA__AEA73749__HA

SEQ ID NO: 6908 - RNA, 1698 nt, Artificial Sequence
  derived and/or modified CDS sequence (AUadapt) from InfluenzaA__AEA73760__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugucgguggucagcucccacuacagccgcaaguucacccccgagaucgccaagcggcccaagauccgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggugaccaucggcgagugccccaaguacguccggucggccaagcugcgcauggugaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggucaacagcgugaucgagaagaugaacacccaguucaccgccgucggcaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccauggggguguaccagauccuggcgaucuacagcaccguggccagcucccugguccuccuggugagccugggcgccaucuccuucuggaugugcagcaacggcucccuccagugccggaucugcaucuga

SEQ ID NO: 6909 - RNA, 1701 nt, Artificial Sequence; identical to SEQ ID NO: 116
  derived and/or modified CDS sequence (AUadapt) from InfluenzaA__AEA73771__HA

SEQ ID NO: 6910 - RNA, 1701 nt, Artificial Sequence; identical to SEQ ID NO: 4544
  derived and/or modified CDS sequence (AUadapt) from InfluenzaA__AEA73781__HA

SEQ ID NO: 6911 - RNA, 1701 nt, Artificial Sequence; identical to SEQ ID NO: 4466
  derived and/or modified CDS sequence (AUadapt) from InfluenzaA__AEA73791__HA

SEQ ID NO: 6912 - RNA, 1701 nt, Artificial Sequence; identical to SEQ ID NO: 96
  derived and/or modified CDS sequence (AUadapt) from InfluenzaA__AEA73801__HA

SEQ ID NO: 6913 - RNA, 1701 nt, Artificial Sequence; identical to SEQ ID NO: 4078
  derived and/or modified CDS sequence (AUadapt) from InfluenzaA__AEA73811__HA

SEQ ID NO: 6914 - RNA, 1701 nt, Artificial Sequence; identical to SEQ ID NO: 4636
  derived and/or modified CDS sequence (AUadapt) from InfluenzaA__AEA73821__HA

SEQ ID NO: 6915 - RNA, 1701 nt, Artificial Sequence
  derived and/or modified CDS sequence (AUadapt) from InfluenzaA__AEA73831__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgcggccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccaccgaccagcagagccuguaccagaacgcggacgccuacguguucgugggcaccucccgguacucgaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgagccuggugcucguggucucccugggggcgaucucguucuggaugugcuccaacggcagccugcagugccggaucugcaucuga

SEQ ID NO: 6916 - RNA, 1701 nt, Artificial Sequence
  derived and/or modified CDS sequence (AUadapt) from InfluenzaA__AEA73841__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgaguccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucguggagaagaugaacacccaguucacggccgucgggaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggucaagcucgagagcacccgcaucuaccagauccuggcgaucuacuccaccguggccucgagccuggugcucgucgugucccugggcgccaucucguucuggaugugcuccaacgggagccugcagugccggaucugcaucuga

SEQ ID NO: 6917 - RNA, 1701 nt, Artificial Sequence; identical to SEQ ID NO: 4544
  derived and/or modified CDS sequence (AUadapt) from InfluenzaA__AEA73851__HA

SEQ ID NO: 6918 - RNA, 1701 nt, Artificial Sequence
  derived and/or modified CDS sequence (AUadapt) from InfluenzaA__AEA73861__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucggggagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagaucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6919 - RNA, 1701 nt, Artificial Sequence; identical to SEQ ID NO: 4786
  derived and/or modified CDS sequence (AUadapt) from InfluenzaA__AEA73871__HA

SEQ ID NO: 6920 - RNA, 1701 nt, Artificial Sequence; identical to SEQ ID NO: 4786
  derived and/or modified CDS sequence (AUadapt) from InfluenzaA__AEA73881__HA

SEQ ID NO: 6921 - RNA, 1701 nt, Artificial Sequence; identical to SEQ ID NO: 4466
  derived and/or modified CDS sequence (AUadapt) from InfluenzaA__AEA73891__HA

SEQ ID NO: 6922 - RNA, 1701 nt, Artificial Sequence
  derived and/or modified CDS sequence (AUadapt) from InfluenzaA__AEA73901__HA
augaacgccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccucaucuggcuggucaagaaggggaacucguaccccaagcuguccaagagcuacaucaacgacaagggcaaggaggugcucgugcugugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaagaucaacuccgugaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgucaagcuggagagcacccgcaucuaccagauccuggcgaucuacuccaccguggccucgagccucgugcuggucgugucccugggggccaucucguucuggaugugcuccaacggcagccuccagugccggaucugcaucuga

SEQ ID NO: 6923 - RNA, 1701 nt, Artificial Sequence; identical to SEQ ID NO: 4078
  derived and/or modified CDS sequence (AUadapt) from InfluenzaA__AEA73911__HA

SEQ ID NO: 6924 - RNA, 1701 nt, Artificial Sequence; identical to SEQ ID NO: 4786
  derived and/or modified CDS sequence (AUadapt) from InfluenzaA__AEA73921__HA

SEQ ID NO: 6925 - RNA, 1701 nt, Artificial Sequence; identical to SEQ ID NO: 4544
  derived and/or modified CDS sequence (AUadapt) from InfluenzaA__AEA73931__HA

SEQ ID NO: 6926 - RNA, 1701 nt, Artificial Sequence; identical to SEQ ID NO: 4544
  derived and/or modified CDS sequence (AUadapt) from InfluenzaA__AEA73961__HA

SEQ ID NO: 6927 - RNA, 1701 nt, Artificial Sequence
  derived and/or modified CDS sequence (AUadapt) from InfluenzaA__AEA73971__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacucgaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccagaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcaacaacacgugcauggaguccgugaagaacgggaccuacgacuacccgaaguacagcgaggaggccaagcugaaccgggaggagaucgacggcgugaagcuggaguccacccgcaucuaccagauccucgcgaucuacucgaccgucgccagcucccuggugcugguggucucgcucggggccaucuccuucuggaugugcagcaacggcucccugcagugccggaucugcaucuga

SEQ ID NO: 6928 - RNA, 1701 nt, Artificial Sequence; identical to SEQ ID NO: 4544
  derived and/or modified CDS sequence (AUadapt) from InfluenzaA__AEA73981__HA

SEQ ID NO: 6929 - RNA, 1701 nt, Artificial Sequence
  derived and/or modified CDS sequence (AUadapt) from InfluenzaA__AEA73991__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagaaguucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagccgcuacuccaagaaguucaagcccgagaucgccauccggccgaagguccgcgaccaggagggccggaugaacuacuacuggacccugguggagcccggggacaagaucaccuucgaggccaccggcaaccucguggucccccgcuacgcguucgccauggagcggaacgccgggucgggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgucgauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggccaucuacagcaccgucgcgucgucccuggugcucguggucagccugggggccaucuccuucuggaugugcagcaacggcucccugcagugccgcaucugcaucuga

SEQ ID NO: 6930 - RNA, 1701 nt, Artificial Sequence; identical to SEQ ID NO: 4527
  derived and/or modified CDS sequence (AUadapt) from InfluenzaA__AEA74001__HA

SEQ ID NO: 6931 - RNA, 1701 nt, Artificial Sequence
  derived and/or modified CDS sequence (AUadapt) from InfluenzaA__AEA74011__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaagcggaacucguaccccaagcugucccagagcuacaucaacgacaaggggaaggaggugcugguccucuggggcauccaccaccccucgaccuccgccgaccagcagagccuguaccagaacgccgacgccuacguguucguggggacgucccgcuacucgaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucgaucaagaacggcaccuacgacuaccccaaguacuccgaggaggccaagcugaaccgcgaggagaucgacggggugaagcucgagagcacccggaucuaccagauccuggcgaucuacuccaccguggccucgagccugguccucguggugucccugggcgccaucucguucuggaugugcuccaacgggagccugcagugccgcaucugcaucuga

SEQ ID NO: 6932 - RNA, 1701 nt, Artificial Sequence
  derived and/or modified CDS sequence (AUadapt) from InfluenzaA__AEA74021__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucgaucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6933 - RNA, 1701 nt, Artificial Sequence
  derived and/or modified CDS sequence (AUadapt) from InfluenzaA__AEA74031__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaacaaccugaucuggcucgugaagaaggggaacucguaccccaagcugaacaaguccuacaucaacgacaagggcaaggaggugcugguccucugggggauccaccaccccagcaccucgacggaccagcagucccuguaccagaacgccgacgccuacguguucgugggcaccucgcgguacuccaagaaguucaagcccgagaucgccauccgcccgaagguccggaaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccauccacgacugcaacacgaccugccagaccccgaagggcgccaucaacaccucgcugcccuuccagaacauccaccccaucaccaucgggaagugccccaaguacgugaaguccaccaagcugcggcucgccacgggccugcgcaacgugccgagcauccagucccgggggcuguucggcgcgaucgccggguucaucgagggcggcuggaccgggauggucgacggcugguacggguaccaccaccagaacgagcagggcucgggguacgccgccgaccucaaguccacccagaacgccaucgacgagaucaccaacaaggugaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacucgaccguggcguccagccugguccucguggugucgcugggggccaucuccuucuggaugugcagcaacggcucccugcagugccggaucugcaucuga

SEQ ID NO: 6934 - RNA, 1701 nt, Artificial Sequence
  derived and/or modified CDS sequence (AUadapt) from InfluenzaA__AEA74035__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaacaaccugaucuggcucgugaagaaggggaacucguaccccaagcugaacaaguccuacaucaacgacaagggcaaggaggugcugguccucugggggauccaccaccccagcaccucgacggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccauccacgacugcaacacgaccugccagaccccgaagggcgccaucaacaccucgcugcccuuccagaacauccaccccaucaccaucgggaagugccccaaguacgugaaguccaccaagcugcggcucgccacgggccugcgcaacgugccgagcauccagucccgggggcuguucggcgcgaucgccggguucaucgagggcggcuggaccgggauggucgacggcugguacggguaccaccaccagaacgagcagggcucgggguacgccgccgaccucaaguccacccagaacgccaucgacgagaucaccaacaaggugaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacucgaccguggcguccagccugguccucguggugucgcugggggccaucuccuucuggaugugcagcaacggcucccugcagugccggaucugcaucuga

SEQ ID NO: 6935 - RNA, 1701 nt, Artificial Sequence; identical to SEQ ID NO: 2679
  derived and/or modified CDS sequence (AUadapt) from InfluenzaA__AEA77299__HA

SEQ ID NO: 6936 - RNA, 1701 nt, Artificial Sequence; identical to SEQ ID NO: 6680
  derived and/or modified CDS sequence (AUadapt) from InfluenzaA__AEB21316__HA

SEQ ID NO: 6937 - RNA, 1701 nt, Artificial Sequence; identical to SEQ ID NO: 6699
  derived and/or modified CDS sequence (AUadapt) from InfluenzaA__AEB21326__HA

SEQ ID NO: 6938 - RNA, 1701 nt, Artificial Sequence; identical to SEQ ID NO: 6680
  derived and/or modified CDS sequence (AUadapt) from InfluenzaA__AEB21338__HA

SEQ ID NO: 6939 - RNA, 1701 nt, Artificial Sequence; identical to SEQ ID NO: 6699
  derived and/or modified CDS sequence (AUadapt) from InfluenzaA__AEB21348__HA

SEQ ID NO: 6940 - RNA, 1701 nt, Artificial Sequence; identical to SEQ ID NO: 3833
  derived and/or modified CDS sequence (AUadapt) from InfluenzaA__AEB40206__HA

SEQ ID NO: 6941 - RNA, 1701 nt, Artificial Sequence; identical to SEQ ID NO: 3833
  derived and/or modified CDS sequence (AUadapt) from InfluenzaA__AEB66895__HA

SEQ ID NO: 6942 - RNA, 1698 nt, Artificial Sequence
  derived and/or modified CDS sequence (AUadapt) from InfluenzaA__AEB71102__HA
auggaugugcccgucuucgugcugcucaugcugaccucgaucugcgugcaggccgaccgcaucugcgucggcuaccuguccaccaacagcuccgagcggguggacacgcuccuggagaacaacgugccggucaccagcuccguggaccugguggagaccaaccacaccgggacguacugcagccucggcgggaucucccccguccaccugggcgacugcucguucgagggguggaucgugggcaaccccgccugcgcguccaaccugggcauccgcgaguggaguuaccucaucgaggaccccuccgccccgcacgggcugugcuaccccggcgagcuggacaacaacggggagcuccggcaccuguucagcggcauccgcuccuucagccggaccgagcugaucgcccccaccuccuggggcgaggugaacgacggggucaccgccgccugccaggacaagggcgcgagcuccuucuaccgcaaccucgugugguucguggagcgggggaacaaguaccccgucauccgccggacguacaacaauaccaccggccgcgacgugcuggugaucugggggauccaccacccggucucgaccgacgaggcccggaagcuguacgccaaggacaaccccuacacgcucguguccaccagcagcuggucccgcaaguacaaccuggagaccggcacccggcccggcuacaacgggcagaaguccuggacgaagaucuacugguaccugaugcaccccggcgacagcaucucguucgaguccaacgggggccuccuggccccgaaguacggguacaucaucgaggaguacggcaagggccgcaucuuccagagucggauccgcaucgcgaagugcaacaccaagugccagaccuccgucgggggcaucaacaccaacaagacguuccagaacaucgagcggaacgcccugggggacugccccaaguacaucaagagcggccagcucaagcuggccaccgggcugcgcaacgugcccgccaucuccaaccggggccucuucggcgccaucgcgggguucaucgagggcggguggcccggccugaucaacgggugguacggcuuccagcaccagaacgagcagggcauggggauggccgccgacaaggagagcacccagaaggccaucgaccagaucaccacgaagaucaacaacaucaucgagaagaugaauggcaacuacgacuccauccgcggggaguucagccagguggagcagcggaucaacaugcuggccgaccgcaucgacgacgcggugaccgacgucugguccuacaacgccaagcuccuggugcugcucgagaacgacaagacccuggacaugcacgacgccaacguccgcaaccugcacgaccaggugcggcgcgugcuccggaccaacgccaucgacgagggcaacggcugcuucgagcugcugcauaagugcaacgacucgugcauggagacgauccgcaacgggaccuacaaccacaucgaguacgaggaggaguccaagcucaagcggcaggagaucgagggcaucaagcucaagagcgacgacaacgucuacaaggcccuguccaucuacagcugcaucgcguccagcaucgugcugguggggcugauccuggccuucaucaugugggccugcagcuccggcaacugccgcuucaacaucugcaucuga

SEQ ID NO: 6943 - RNA, 1698 nt, Artificial Sequence
  derived and/or modified CDS sequence (AUadapt) from InfluenzaA__AEB71896__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaacaaggagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 6944 - RNA, 1701 nt, Artificial Sequence; identical to SEQ ID NO: 3156
  derived and/or modified CDS sequence (AUadapt) from InfluenzaA__AEB71916__HA

SEQ ID NO: 6945 - RNA, 1701 nt, Artificial Sequence; identical to SEQ ID NO: 2679
  derived and/or modified CDS sequence (AUadapt) from InfluenzaA__AEB71925__HA

SEQ ID NO: 6946 - RNA, 1701 nt, Artificial Sequence; identical to SEQ ID NO: 2679
  derived and/or modified CDS sequence (AUadapt) from InfluenzaA__AEB71936__HA

SEQ ID NO: 6947 - RNA, 1701 nt, Artificial Sequence; identical to SEQ ID NO: 2679
  derived and/or modified CDS sequence (AUadapt) from InfluenzaA__AEB71947__HA

SEQ ID NO: 6948 - RNA, 1698 nt, Artificial Sequence; identical to SEQ ID NO: 6217
  derived and/or modified CDS sequence (AUadapt) from InfluenzaA__AEB71958__HA

SEQ ID NO: 6949 - RNA, 1701 nt, Artificial Sequence; identical to SEQ ID NO: 5664
  derived and/or modified CDS sequence (AUadapt) from InfluenzaA__AEB71969__HA

SEQ ID NO: 6950 - RNA, 1701 nt, Artificial Sequence
  derived and/or modified CDS sequence (AUadapt) from InfluenzaA__AEB71980__HA
augaagaccaucaucgcccugucgugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 6951 - RNA, 1698 nt, Artificial Sequence; identical to SEQ ID NO: 3861
  derived and/or modified CDS sequence (AUadapt) from InfluenzaA__AEB71992__HA

SEQ ID NO: 6952 - RNA, 1698 nt, Artificial Sequence; identical to SEQ ID NO: 3861
  derived and/or modified CDS sequence (AUadapt) from InfluenzaA__AEC13313__HA

SEQ ID NO: 6953 - RNA, 1701 nt, Artificial Sequence
  derived and/or modified CDS sequence (AUadapt) from InfluenzaA__AEC46553__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaccuccuacaucaacgacaagggcaaggaggugcugguccucugggggauccaccaccccagcacgucggccgaccagcagucccuguaccagaacgccgacgccuacgccuucgugggcaccagccgguacuccaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccgggucgggcaucaucaucuccgacaccagcguccacgacugcaacacgaccugccagaccccgaagggcgcgaucaacaccucccugcccuuccagaacgugcaccccaucaccaucgggaagugccccaaguacgucaagucgaccaagcugcggcucgccacgggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacccagaacgccuucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 6954 - RNA, 1701 nt, Artificial Sequence
  derived and/or modified CDS sequence (AUadapt) from InfluenzaA__AEC46555__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaccuccuacaucaacgacaagggcaagaaggugcugguccucugggggauccaccaccccagcacgucggccgaccagcagucccuguaccagaacgccgacgccuacgccuucgugggcaccagccgguacuccaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgaggggucgggcaucaucaucuccgacaccagcguccacgacugcaacacgaccugccagaccccgaagggcgccaucaacaccucccugcccuuccagaacgugcaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcguucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6955 - RNA, 1701 nt, Artificial Sequence; identical to SEQ ID NO: 6953
  derived and/or modified CDS sequence (AUadapt) from InfluenzaA__AEC46557__HA

SEQ ID NO: 6956 - RNA, 1701 nt, Artificial Sequence; identical to SEQ ID NO: 62
  derived and/or modified CDS sequence (AUadapt) from InfluenzaA__AEC53259__HA

SEQ ID NO: 6957 - RNA, 1701 nt, Artificial Sequence
  derived and/or modified CDS sequence (AUadapt) from InfluenzaA__AEC53269__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcugcugagcuccgugucguccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacucguaccccaagcuguccaagagcuacaucaacgacaagggcaaggaggugcucguccugugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcucguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcuccggcuggcgaccggccugcgcaacaucccgagcauccagucccggggccucuucggggccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacucggugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcucaaccgggaggagaucgacggcgugaagcuggaguccacccgcaucuaccagauccuggcgaucuacagcaccguggccucgucccucguccugguggugagccugggggccaucuccuucuggaugugcagcaacggcucccuccagugccggaucugcaucuga

SEQ ID NO: 6958 - RNA, 1701 nt, Artificial Sequence; identical to SEQ ID NO: 3644
  derived and/or modified CDS sequence (AUadapt) from InfluenzaA__AEC53279__HA

SEQ ID NO: 6959 - RNA, 1701 nt, Artificial Sequence; identical to SEQ ID NO: 62
  derived and/or modified CDS sequence (AUadapt) from InfluenzaA__AEC53289__HA

SEQ ID NO: 6960 - RNA, 1701 nt, Artificial Sequence; identical to SEQ ID NO: 62
  derived and/or modified CDS sequence (AUadapt) from InfluenzaA__AEC53299__HA

SEQ ID NO: 6961 - RNA, 1701 nt, Artificial Sequence; identical to SEQ ID NO: 96
  derived and/or modified CDS sequence (AUadapt) from InfluenzaA__AEC53327__HA

SEQ ID NO: 6962 - RNA, 1701 nt, Artificial Sequence
  derived and/or modified CDS sequence (AUadapt) from InfluenzaA__AEC53347__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugaucgagcccggggacaagaucaccuucgaggcgaccggcaaccucguggugccccgguacgccuucgccauggagcgcaacgccgggucgggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 6963 - RNA, 1701 nt, Artificial Sequence
  derived and/or modified CDS sequence (AUadapt) from InfluenzaA__AEC53404__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaaggggaucaccgccgccugcccgcacgccggcgcgaaguccuucuacaagaaccugaucuggcuggucaagaaggggaacagcuaccccaagcucuccaagucguacaucaacgacaagggcaaggaggugcuggugcugugggggauccaccaccccagcaccuccgccgaccagcagucgcucuaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccugguggugccccgguacgccuucgccauggagcgcaacgccgggucgggcaucaucaucuccgacacccccguccacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgugccgucgauccagucccgggggcuguucggcgccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacucggugaucgagaagaugaacacccaguucaccgccgucggcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcagccagcucaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcuggaguccacccgcaucuaccagauccucgcgaucuacagcaccguggccucgucccugguccugguggugagccucggggccaucuccuucuggaugugcagcaacggcucccugcagugccggaucugcaucuga

SEQ ID NO: 6964 - RNA, 1701 nt, Artificial Sequence; identical to SEQ ID NO: 62
  derived and/or modified CDS sequence (AUadapt) from InfluenzaA__AEC53414__HA

SEQ ID NO: 6965 - RNA, 1701 nt, Artificial Sequence
  derived and/or modified CDS sequence (AUadapt) from InfluenzaA__AEE27177__HA
augaagaccauccuggugguccuccuguacaccuucgccacggccaacgcggacacccugugcaucggcuaccacgccaacaacucgaccgacaccguggacacggugcucgagaagaacgucaccgugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagacguccucguccgacaacgggaccugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgccaaguccuucuacaagaaccugaucuggcuggugaagaaggggaacagcuaccccaagcucuccaagucguacaucaacgacaagcggaaggaggugcugguccuguggggcauccaccaccccagcacguccgcggaccagcagucgcucuaccagaacgccgacgccuacguguucgugggguccagccgcuacuccaagaaguucaagcccgagaucgccauccggccgaagguccgcgaccaggagggccggaugaacuacuacuggacccugguggagcccggcgacaagaucaccuucgaggccaccgggaaccugguggucccccgcuacgcguucgccauggagcggaacgccggcucggggaucaucaucuccgacacgcccgugcacgacugcaacacgaccugccagaccccgaagggcgccaucaacaccagccuccccuuccagaacauccaccccaucaccaucggcaagugccccaaguacgugaaguccaccaagcugcgccuggccaccgggcuccggaacgucccgucgauccagucccgcggccuguucggggcgaucgccggcuucaucgagggcggcuggacgggcaugguggacgggugguacggcuaccaccaccagaacgagcaggggagcggcuacgccgccgaccugaaguccacccagaacgccaucgacgagaucaccaacaaggugaacucggucaucgagaagaugaacacccaguucacggcgguggggaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgugaagaaccuguacgagaagguccggagccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcuggaguccacccggaucuaccagauccucgccaucuacagcaccgucgcgucgucccuggugcugguggucagccucggcgccaucuccuucuggaugugcagcaacgggucccugcagugccgcaucugcaucuga

SEQ ID NO: 6966 - RNA, 1701 nt, Artificial Sequence; identical to SEQ ID NO: 4686
  derived and/or modified CDS sequence (AUadapt) from InfluenzaA__AEE27187__HA

SEQ ID NO: 6967 - RNA, 1701 nt, Artificial Sequence
  derived and/or modified CDS sequence (AUadapt) from InfluenzaA__AEE27207__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaaggugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6968 - RNA, 1701 nt, Artificial Sequence
  derived and/or modified CDS sequence (AUadapt) from InfluenzaA__AEG64752__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugcgguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggcgccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6969 - RNA, 1701 nt, Artificial Sequence
  derived and/or modified CDS sequence (AUadapt) from InfluenzaA__AEG64762__HA
augaaggcccgccugcucgugcugcugugcgcccucgcggccaccgacgccgacaccaucugcaucggcuaccacgccaacaacucgacggacaccgucgacacccugcuggagaagaacgugaccgugacgcacuccgucaaccuccuggaggacagccacaacgggaagcugugcaagcucaagggcaucgcgccccugcagcuggggaagugcaacaucgccggcuggcuccuggggaacccggagugcgacucccugcuccccgcccggucgugguccuacaucguggagacccccaacagcgagaacggcgccugcuaccccggcgacuucaucgacuacgaggagcugcgcgagcagcuguccaccgugagcucccucgagcgguucgagaucuucccgaaggagucguccuggcccaaccacaacacccugaagggggucacggugagcugcucccacggcggcaagagcuccuucuaccgcaaccugcucuggcugaccaagaccggggacucguaccccaagcugaacaacuccuacgugaacaacaaggggaaggagguccucgugcuguggggcgugcaccaccccagcuccagcaacgagcagcagucgcuguaccacaacgucaacgccuacguguccguggucagcuccaacuacaaccggcgcuucaccccggagaucgcggcccggcccaaggugcgcgaccagcccggccggaugaacuacuacuggacgcuccuggagcccggggacaccauccuguucgaggccaccggcaaccucaucgccccgugguacgccuucgcgcugagccgcggguucggcuccggcaucaucaccucgaacgccuccaugcacgagugcaacacgaagugccagacgccccagggggccaucaacagcucccugcccuuccagaacauccaccccgugaccaucggcgagugcccgaaguacguccggagcaccaagcuccgcauggugaccgggcugcggaacauccccuccauccagucgcgcggccuguucggggccaucgccggcuucaucgagggcggguggaccggcaugaucgacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaaccucgagaagcggauggagaaccugaacaagaagguggacgacggcuuccuggacaucuggaccuacaacgccgagcuccugguccugcucgagaacgagcgcacccuggacuuccacgaccugaacgugaagaaccucuacgagaaggucaagagccagcugaagaacaacgcgaaggagaucgggaacggcugcuucgaguucuaccacaagugcgacaacgagugcauggaguccgugcgggacgggacguacgacuaccccaaguacucggaggaguccaagcugaaccgcgagaagaucgacggcgugaagcucgagagcaugggcgucuaccagauccuggccaucuacagcaccguggccuccucgcuggugcugcucgucucccugggggccaucagcuucuggaugugcuccaacggcagccugcagugccggaucugcaucuga

SEQ ID NO: 6970 - RNA, 1701 nt, Artificial Sequence; identical to SEQ ID NO: 116
  derived and/or modified CDS sequence (AUadapt) from InfluenzaA__AEG64784__HA

SEQ ID NO: 6971 - RNA, 1701 nt, Artificial Sequence
  derived and/or modified CDS sequence (AUadapt) from InfluenzaA__AEG64834__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccgccggggagaucugcgacagcccccaccagauccucgacggcgagaacugcacccugaucgacgcccugcucggggacccccagugcgacggcuuccagaacaagaagugggaccuguucguggagcgcucccgggcguacucgaacugcuaccccuacgacgugccggacuacgccucccugcgcagccucgucgccuccucgggcacccuggaguucaacaacgaguccuucaacuggacgggggugacccagaacggcaccagcuccgccugcauccggcgcucgaacaacuccuucuucucgcggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccgggcgcaucaccgugagcaccaagcggucccagcaggccgugaucccgaacaucggcucgcgcccccggguccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcgcccaucgggaagugcaacuccgagugcaucacccccaacggcucgauccccaacgacaagccguuccagaacgugaaccggaucaccuacggggccugcccccgcuacgucaagcaguccacgcugaagcucgccaccggcaugcggaacgugcccgagaagcagacccgcgggaucuucggcgccaucgccggguucaucgagaacggcugggagggcaugguggacgggugguacggcuuccggcaccagaacagcgaggggcgcggccaggcggccgaccugaaguccacccaggccgccaucgaccagaucaacgggaagcugaaccggcucaucggcaagacgaacgagaaguuccaccagaucgagaaggaguucucggaggucgagggccgcauccaggaccuggagaaguacguggaggacaccaagaucgaccugugguccuacaacgccgagcuccugguggcgcuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgccugcaucggguccauccggaacggcaccuacgaccacgacgucuaccgcgacgaggcccucaacaaccgguuccagaucaaggggguggagcucaagucgggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 6972 - RNA, 1701 nt, Artificial Sequence
  derived and/or modified CDS sequence (AUadapt) from InfluenzaA__AEG64845__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcagaccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 6973 - RNA, 1701 nt, Artificial Sequence
  derived and/or modified CDS sequence (AUadapt) from InfluenzaA__AEG64856__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucagcaucuacuggacgaucgucaagcccggcgacauccuccugaucaacuccaccgggaaccugaucgcgccccggggcuacuucaagauccgcucggggaaguccagcgugaugcgguccgacgccucgaucggcaagugcaacuccgagugcaucaccccgaacggcagcauccccaacgacaagcccuuccagaacgugaaccgcaucaccuacggggccugcccccgguacgucaagcagaacacgcucaagcuggccaccggcaugcgcaacgugccggagaagcagacccgggggaucuucggcgccaucgccggguucaucgagaacggcugggagggcaugguggacgggugguacggcuuccgccaccagaacuccgaggggaccggccaggccgcggaccugaaguccacgcaggccgccaucaaccagaucaacgggaagcucaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucgagagcauccgcaacggcaccuacgaccacgacgucuaccgggacgaggcccugaacaaccgcuuccagaucaaggggguggagcucaagucgggcuacaaggacuggauccuguggaucuccuucgccaucagcugcuuccugcugugcgucgugcuccugggguucaucaugugggccugccagaagggcaacauccggugcaacaucugcaucuga

SEQ ID NO: 6974 - RNA, 1701 nt, Artificial Sequence; identical to SEQ ID NO: 317
  derived and/or modified CDS sequence (AUadapt) from InfluenzaA__AEG64867__HA

SEQ ID NO: 6975 - RNA, 1701 nt, Artificial Sequence
  derived and/or modified CDS sequence (AUadapt) from InfluenzaA__AEG64878__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgucgcuccgcucccugguggccagcuccggcacccuggaguucaacaacgagucguucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucagcucccggaucucgaucuacuggaccaucgugaagcccggcgacauccuccugaucaacuccaccggcaaccugaucgcgccccggggguacuucaagauccgcagcggcaaguccucgaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcaucgggcaggccgcggaccugaaguccacgcaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 6976 - RNA, 1701 nt, Artificial Sequence
  derived and/or modified CDS sequence (AUadapt) from InfluenzaA__AEG64889__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgucgcuccgcucccuguucgccagcuccggcacccuggaguucaacaacgagucguucaacuggaccggcguggcccagaacgggaccuccagcgccugcaagcggcgcuccaucaagagcuucuucucccggcucaacuggcugcaccagcugaaguacaaguaccccgcgcucaacgugacgaugcccaacaacgagaaguucgacaagcuguacaucuggggcguccaccaccccucgaccgacuccgaccagaucagccuguacgcccaggccucggggcgcgugaccguguccaccaagcggagccagcagacggucaucccgaacaucggcucccgccccugggugcgcggggugagcucccggaucucgaucuacuggaccaucgucaagcccggcgacauccuccugaucaacuccaccggcaaccugaucgcgccccggggguacuucaagauccgcagcggcaaguccucgaucaugcgguccaacgccccgaucgggaagugcaacagcgagugcaucacccccaacggcuccauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagaagacccggaagcagcuccgcgagaacgcggaggacaugggcaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggguucaucaugugggccugccagaagggcaacauccggugcaacaucugcaucuga

SEQ ID NO: 6977 - RNA, 1701 nt, Artificial Sequence; identical to SEQ ID NO: 277
  derived and/or modified CDS sequence (AUadapt) from InfluenzaA__AEG64911__HA

SEQ ID NO: 6978 - RNA, 1701 nt, Artificial Sequence; identical to SEQ ID NO: 277
  derived and/or modified CDS sequence (AUadapt) from InfluenzaA__AEG64922__HA

SEQ ID NO: 6979 - RNA, 1701 nt, Artificial Sequence; identical to SEQ ID NO: 277
  derived and/or modified CDS sequence (AUadapt) from InfluenzaA__AEG64933__HA

SEQ ID NO: 6980 - RNA, 1701 nt, Artificial Sequence; identical to SEQ ID NO: 363
  derived and/or modified CDS sequence (AUadapt) from InfluenzaA__AEG64944__HA

SEQ ID NO: 6981 - RNA, 1701 nt, Artificial Sequence; identical to SEQ ID NO: 277
  derived and/or modified CDS sequence (AUadapt) from InfluenzaA__AEG64955__HA

SEQ ID NO: 6982 - RNA, 1701 nt, Artificial Sequence; identical to SEQ ID NO: 277
  derived and/or modified CDS sequence (AUadapt) from InfluenzaA__AEG64966__HA

SEQ ID NO: 6983 - RNA, 1701 nt, Artificial Sequence
  derived and/or modified CDS sequence (AUadapt) from InfluenzaA__AEG64977__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgggaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucgacuggaccggggugacccagaacggcaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcgggcggaucaccgugucgacgaagcgcucccagcagaccgugaucccgaacaucggcucgcggccccgcguccgggacguguccagccgcaucuccaucuacuggaccaucgugaagcccggcgacauccugcucaucaacucgaccgggaaccugaucgcgccccggggcuacuucaagauccgcuccgggaaguccuccaucaugcggucggacgccccgaucgacaagugcaacuccgagugcaucacgcccaacggcagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacuccgagggcaccgggcaggccgccgaccucaagucgacccaggcggccaucaaccagaucaacggcaagcugaaccggcugaucgggaagaccaacgagaaguuccaccagaucgagaaggaguucuccgagguggagggccgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggguacaaggacuggauccuguggaucucguucgccaucagcugcuuccuccugugcgucgcccugcucggcuucaucaugugggccugccagaagggcaacauccggugcaacaucugcaucuga

SEQ ID NO: 6984 - RNA, 1701 nt, Artificial Sequence
  derived and/or modified CDS sequence (AUadapt) from InfluenzaA__AEG64988__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacaugccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcaagcgccggagcaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccggcaagagcuccaucaugcggucggacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgugguccugcucggcuucaucaugugggccugccagaaggggaacauccggugcaacaucugcaucuga

SEQ ID NO: 6985 - RNA, 1701 nt, Artificial Sequence
  derived and/or modified CDS sequence (AUadapt) from InfluenzaA__AEG64999__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgucucccugcggucgcucguggcguccagcgggacgcuggaguucaacaacgaguccuucaacuggaccggcgugacccagaacgggaccucguccgccugcaagcgccggagcaacaacuccuucuucucgcgccugaacuggcucacgcaccugaaguucaaguaccccgcccugaacgucaccaugcccaacaacgagaaguucgacaagcucuacaucuggggcgugcaccaccccgggaccgacaacgaccagaucucccuguacgcccaggcgucgggccggaucaccguguccacgaagcgcagccagcagaccgucaucccgaacaucggcucgcggccccgcgugcgggacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacucggagggcaucgggcaggccgccgaccugaaguccacccaggccgcgaucaaccagaucaacggcaagcugaaccggcucaucggcaagaccaacgagaaguuccaccagaucgagaaggaguucucggagguggaggggcgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcgcucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 6986 - RNA, 1701 nt, Artificial Sequence; identical to SEQ ID NO: 500
  derived and/or modified CDS sequence (AUadapt) from InfluenzaA__AEG65010__HA

SEQ ID NO: 6987 - RNA, 1701 nt, Artificial Sequence
  derived and/or modified CDS sequence (AUadapt) from InfluenzaA__AEG65021__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucucgcugcggucccucguggcgagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgucaccaugcccaacaccgagaaguucgacaagcucuacaucuggggcgugcaccaccccgggaccgacaacgaccagaucucgcuguacgcccaggcguccggccggaucacggugagcaccaagcgcucgcagcagaccgucaucccgaacaucggcucccggccccgcgugcgggacauccccagccgcaucuccaucuacuggaccaucgugaagcccggggacauccugcucaucaacucgacgggcaaccugaucgccccgcggggguacuucaagauccgcuccggcaagucguccaucaugcggagcgacgcccccaucggcaagugcaacuccgagugcaucacccccaacgggucgauccccaacgacaagccguuccagaacgucaaccgcaucaccuacggcgccugcccccgguacgugaagcagaacacccugaagcucgccacggggaugcgcaacgugcccgagaagcagacccggggcaucuucggggcgaucgccggcuucaucgagaacggcugggaggggauggucgacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 6988 - RNA, 1701 nt, Artificial Sequence
  derived and/or modified CDS sequence (AUadapt) from InfluenzaA__AEG65032__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaacaagcucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 6989 - RNA, 1701 nt, Artificial Sequence; identical to SEQ ID NO: 875
  derived and/or modified CDS sequence (AUadapt) from InfluenzaA__AEG65043__HA

SEQ ID NO: 6990 - RNA, 1701 nt, Artificial Sequence; identical to SEQ ID NO: 875
  derived and/or modified CDS sequence (AUadapt) from InfluenzaA__AEG65054__HA

SEQ ID NO: 6991 - RNA, 1701 nt, Artificial Sequence
  derived and/or modified CDS sequence (AUadapt) from InfluenzaA__AEG65065__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacugggugcuguggaucuccuucgccaucagcugcuuccuccugugcgucgugcugcucggcuucaucaugugggccugccagaaggggaacauccggugcaacaucugcaucuga

SEQ ID NO: 6992 - RNA, 1701 nt, Artificial Sequence
  derived and/or modified CDS sequence (AUadapt) from InfluenzaA__AEG65076__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccuccgguucaaguaccccgcccugaacgugaccaugcccaacaacgagaaguucgacaagcuguacaucuggggcguccaccaccccgggaccgacaacgaccagaucuuccuguacgcgcaggccagcggccgcaucaccguguccacgaagcggucgcagcagaccgugaucccgaacgucggcucgcgcccccgggugcgcaacauccccucccggaucagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggagugcaucacgcccaacggguccauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacucggagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 6993 - RNA, 1701 nt, Artificial Sequence
  derived and/or modified CDS sequence (AUadapt) from InfluenzaA__AEG65087__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 6994 - RNA, 1701 nt, Artificial Sequence
  derived and/or modified CDS sequence (AUadapt) from InfluenzaA__AEG65098__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacgacuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggcgugacccagaacgggaccuccucggccugcaagcgccgguccaacaacagcuucuucucccgccugaacuggcucacgcacucgaaguucaaguaccccgcccugaacgugaccaugcccaacaacgagaaguucgacaagcuguacaucuggggcguccaccaccccgggaccgacaacgaccagaucuuccucuacgcgcaggccuccggccggaucaccgugagcacgaagcgcucgcagcagaccgugaucccgaacaucgggucccggccccgcguccggaacauccccagccgcaucuccaucuacuggaccaucgugaagcccggcgacauccugcugaucaacucgaccggcaaccucaucgccccgcggggguacuucaagauccgcuccggcaagagcuccaucaugcggucggacgcccccaucgggaagugcaacuccgagugcaucacgcccaacggcagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacgggugggagggcaugguggacggcugguacggguuccgccaccagaacuccgagggcaucgggcaggccgccgaccucaagucgacccaggcggccaucaaccagaucaacggcaaccugaaccggcugaucgggaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggguacaaggacuggauccuguggaucagcuucgccaucuccugcuuccugcucugcgugguccugcugggcuucaucaugugggccugccagaagggcaacauccggugcaacaucugcaucuga

SEQ ID NO: 6995 - RNA, 1701 nt, Artificial Sequence
  derived and/or modified CDS sequence (AUadapt) from InfluenzaA__AEG65109__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcaagcugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacccuggaguucaacaacgagucguucaacuggacgggggugacccagaacggcaccuccagcgccugcaagcgccgguccaacaacucguucuucucccgccugaacuggcucacccaccugaaguucaaguaccccgcccugaacgugacgaugcccaacaacgagaaguucgacaagcucuacaucuggggcguccaccaccccgggaccgacaacgaccagaucuuccuguacgcgcagagcuccgggcggaucaccgugucgaccaagcgcagccagcagacggugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacccccaacggcagcauccccaacgacaagccguuccagaacgugaaccgcaucacguacggggccugcccccgguacgucaagcagaacacccugaagcucgccaccggcaugcgcaacgugcccgagaagcagacccgggggaucuucggcgcgaucgccggguucaucgagaacggcugggagggcaugguggacgggugguacggcuuccgccaccagaacuccgaggggaucggccaggccgccgaccucaagucgacgcaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacauggggaacggcugcuucaagaucuaccacaagugcgacaacgccugcaucgggucgauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 6996 - RNA, 1701 nt, Artificial Sequence
  derived and/or modified CDS sequence (AUadapt) from InfluenzaA__AEG65120__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucgccuacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggaucggccaggccgcggaccugaaguccacgcaggccgccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacucggagaugaacaagcuguucgagcggaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 6997 - RNA, 1701 nt, Artificial Sequence
  derived and/or modified CDS sequence (AUadapt) from InfluenzaA__AEG65131__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcacagcaaguucaaguaccccgcccugaacgugaccaugcccaacaacgagaaguucgacaagcuguacaucuggggcguccaccaccccgggaccgacaacgaccagaucuuccucuacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcugaucaacagcaccgggaaccucaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucaaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcgugguccugcugggcuucaucaugugggccugccagaaggggaacauccggugcaacaucugcaucuga

SEQ ID NO: 6998 - RNA, 1701 nt, Artificial Sequence; identical to SEQ ID NO: 296
  derived and/or modified CDS sequence (AUadapt) from InfluenzaA__AEG65142__HA

SEQ ID NO: 6999 - RNA, 1701 nt, Artificial Sequence; identical to SEQ ID NO: 296
  derived and/or modified CDS sequence (AUadapt) from InfluenzaA__AEG65153__HA

SEQ ID NO: 7000 - RNA, 1701 nt, Artificial Sequence
  derived and/or modified CDS sequence (AUadapt) from InfluenzaA__AEG65164__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacagcaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgaguuccugguggcccuggagaaccagcacaccaucgaccucacggacuccgagaugaacaagcuguucgagcggaccaagaagcagcugcgcgagaacgccgaggacauggggaacggcugcuucaagaucuaccacaagugcgacaacgccugcaucgggucgauccgcaacggcaccuacgaccacgacguguaccgggacgaggcgcucaacaaccgcuuccagaucaagggggucgagcugaaguccggcuacaaggacuggauccuguggaucagcuucgccaucagcugcuuccuccugugcaucgugcugcucggcuucaucaugugggccugccagaaggggaacauccggugcaacaucugcaucuga

SEQ ID NO: 7001 - RNA, 1701 nt, Artificial Sequence
  derived and/or modified CDS sequence (AUadapt) from InfluenzaA__AEG65175__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugagcacgaagcgcucccagcagaccgugaucccgaacaucggcucgcggccccgcguccgggacguguccucgcgcaucuccaucuacuggaccaucgugaagcccggggacauccugcucaucaacagcaccggcaaccugaucgcgccccggggguacuucaagauccgcaacggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcgacaucugcaucuga

SEQ ID NO: 7002 - RNA, 1701 nt, Artificial Sequence; identical to SEQ ID NO: 664
  derived and/or modified CDS sequence (AUadapt) from InfluenzaA__AEG65186__HA

SEQ ID NO: 7003 - RNA, 1701 nt, Artificial Sequence
  derived and/or modified CDS sequence (AUadapt) from InfluenzaA__AEG65197__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucgucccccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuacccguacgacgugcccgacuacgcgucccugcggucgcucgucgccuccagcgggacgcuggaguucaacaacgaguccuucaacuggaccggcgugacccagaacgggaccucguccgccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccacccggggaccgacaacgaccagaucucccuguacgcgcaggccucgggccggaucaccguguccacgaagcgcucgcagcagaccgugauccccaacaucggcagccggccccgcguccgggacauccccucccgcaucucgaucuacuggaccaucgugaagccgggggacaucauccugaucaacuccaccggcaaccucaucgcgccccggggguacuucaagauccgcucgggcaaguccagcaucaugcgguccgacacgcccaucggcaagugcaacucggagugcaucacccccaacggguccaucccgaacgacaagcccuuccagaacgugaaccgcaucaccuacggcgccugcccccgguacgucaagcagaacacccugaagcuggccacggggaugcgcaacgugcccgagaagcagacccggggcaucuucggggccaucgccggcuucaucgagaacggcugggaggggaugguggacggcugguacggguuccgccaccagaacucggagggcaucgggcaggccgccgaccucaaguccacccaggccgcgaucaaccagaucaacggcaagcugaaccggcugaucggcaagaccaacgagaaguuccaccagaucgagaaggaguucagcgaggucgaggggcgcauccaggaccucgagaaguacguggaggacacgaagaucgaccugugguccuacaacgccgagcugcucguggcccuggagaaccagcacaccaucgaccugaccgacucggagaugaacaagcuguucgagcggaccaagaagcagcuccgcgagaacgccgaggacaugggcaacgggugcuucaagaucuaccacaagugcgacaacgccugcaucggcuccauccgcaacgggacguacgaccacgacgucuaccgggacgaggcgcugaacaaccgcuuccagaucaagggcguggagcucaagucgggcuacaaggacuggauccuguggaucuccuucgccaucagcugcuuccugcucugcguggcccugcugggguucaucaugugggccugccagaagggcaacauccggugcaacaucugcaucuga

SEQ ID NO: 7004 - RNA, 1701 nt, Artificial Sequence; identical to SEQ ID NO: 875
  derived and/or modified CDS sequence (AUadapt) from InfluenzaA__AEG65208__HA

SEQ ID NO: 7005 - RNA, 1701 nt, Artificial Sequence
  derived and/or modified CDS sequence (AUadapt) from InfluenzaA__AEG65219__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacaucaagugcaacaucugcaucuga

SEQ ID NO: 7006 - RNA, 1701 nt, Artificial Sequence; identical to SEQ ID NO: 2040
  derived and/or modified CDS sequence (AUadapt) from InfluenzaA__AEG65230__HA

SEQ ID NO: 7007 - RNA, 1701 nt, Artificial Sequence; identical to SEQ ID NO: 2040
  derived and/or modified CDS sequence (AUadapt) from InfluenzaA__AEG65252__HA

SEQ ID NO: 7008 - RNA, 1701 nt, Artificial Sequence; identical to SEQ ID NO: 761
  derived and/or modified CDS sequence (AUadapt) from InfluenzaA__AEG65263__HA

SEQ ID NO: 7009 - RNA, 1701 nt, Artificial Sequence; identical to SEQ ID NO: 761
  derived and/or modified CDS sequence (AUadapt) from InfluenzaA__AEG65274__HA

SEQ ID NO: 7010 - RNA, 1701 nt, Artificial Sequence; identical to SEQ ID NO: 761
  derived and/or modified CDS sequence (AUadapt) from InfluenzaA__AEG65285__HA

SEQ ID NO: 7011 - RNA, 1701 nt, Artificial Sequence
  derived and/or modified CDS sequence (AUadapt) from InfluenzaA__AEG65296__HA
augaagaccgugaucgcccugucguacauccucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgucccggaccacgcgucgcugcggucccucguggccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgucaccaugcccaacaacgagaaguucgacaagcucuacaucuggggcgugcaccaccccgggaccgacucggaccagaucucccuguacgcgcaggccucgggccggaucaccgugucgacgaagcgcucccagcagaccgucaucccgaacaucggcagccggccccgcgugcgggacguguccucgcgcaucuccaucuacuggaccaucgucaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 7012 - RNA, 1701 nt, Artificial Sequence; identical to SEQ ID NO: 2040
  derived and/or modified CDS sequence (AUadapt) from InfluenzaA__AEG65307__HA

SEQ ID NO: 7013 - RNA, 1701 nt, Artificial Sequence
  derived and/or modified CDS sequence (AUadapt) from InfluenzaA__AEG65318__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugcgccagaacacccugaagcucgcgaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcucgauccggaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 7014 - RNA, 1701 nt, Artificial Sequence; identical to SEQ ID NO: 2040
  derived and/or modified CDS sequence (AUadapt) from InfluenzaA__AEG65329__HA

SEQ ID NO: 7015 - RNA, 1701 nt, Artificial Sequence
  derived and/or modified CDS sequence (AUadapt) from InfluenzaA__AEG65340__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcgagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaaggggguggagcugaaguccggcuacaaggacuggauccuguggaucucguucgccaucagcugcuuccuccugugcgucgcccugcucggcuucaucaugugggccugccagaaggggaacauccggugcaacaucugcaucuga

SEQ ID NO: 7016 - RNA, 1701 nt, Artificial Sequence; identical to SEQ ID NO: 2040
  derived and/or modified CDS sequence (AUadapt) from InfluenzaA__AEG65351__HA

SEQ ID NO: 7017 - RNA, 1701 nt, Artificial Sequence; identical to SEQ ID NO: 2040
  derived and/or modified CDS sequence (AUadapt) from InfluenzaA__AEG65362__HA

SEQ ID NO: 7018 - RNA, 1701 nt, Artificial Sequence; identical to SEQ ID NO: 7015
  derived and/or modified CDS sequence (AUadapt) from InfluenzaA__AEG65373__HA

SEQ ID NO: 7019 - RNA, 1701 nt, Artificial Sequence; identical to SEQ ID NO: 761
  derived and/or modified CDS sequence (AUadapt) from InfluenzaA__AEG65384__HA

SEQ ID NO: 7020 - RNA, 1701 nt, Artificial Sequence; identical to SEQ ID NO: 761
  derived and/or modified CDS sequence (AUadapt) from InfluenzaA__AEG65406__HA

SEQ ID NO: 7021 - RNA, 1701 nt, Artificial Sequence; identical to SEQ ID NO: 761
  derived and/or modified CDS sequence (AUadapt) from InfluenzaA__AEG65417__HA

SEQ ID NO: 7022 - RNA, 1701 nt, Artificial Sequence; identical to SEQ ID NO: 761
  derived and/or modified CDS sequence (AUadapt) from InfluenzaA__AEG65428__HA

SEQ ID NO: 7023 - RNA, 1701 nt, Artificial Sequence
  derived and/or modified CDS sequence (AUadapt) from InfluenzaA__AEG65439__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcgucgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 7024 - RNA, 1701 nt, Artificial Sequence
  derived and/or modified CDS sequence (AUadapt) from InfluenzaA__AEG65450__HA
augaagaccaucaucgccuggucguacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccugaucgccucguccgggacgcucgaguucaacaacgagagcuucaacuggaccggcgucacccagaacgggaccuccucggccugcaagcgccgguccaacagcuccuucuucucgcgccugaacuggcugacgcaccucaaguucaaguaccccgcccugaacgugaccaugcccaacaacgaggaguucgacaagcuguacaucuggggcgugcaccaccccgggaccuacaacgaccagaucucccucuacgcgcaggccagcggccggaucaccgucucgacgaagcgcucccagcagaccgugaucccgaacaucggcucgcggccccgcgugcgggacauccccucccgcaucagcaucuacuggaccaucgucaagcccggggacauccugcugaucaacuccaccggcaaccucaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgugaagcagaacacccugaagcuggcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccucaaguccacccaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagucgggcuacaaggacuggauccuguggaucuccuucgccaucagcugcuuccugcucugcguggcccugcugggguucaucaugugggccugccagaagggcaacauccggugcaacaucugcaucuga

SEQ ID NO: 7025 - RNA, 1701 nt, Artificial Sequence; identical to SEQ ID NO: 7024
  derived and/or modified CDS sequence (AUadapt) from InfluenzaA__AEG65461__HA

SEQ ID NO: 7026 - RNA, 1701 nt, Artificial Sequence
  derived and/or modified CDS sequence (AUadapt) from InfluenzaA__AEG65472__HA
augaagaccaucaucgccuggucguacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccucgaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccugaucgccagcuccgggacgcucgaguucaacaacgagucguucaacuggaccggcgucacccagaacgggaccuccagcgccugcaagcgccgguccaacucguccuucuucagccgccugaacuggcugacgcaccucaaguucaaguaccccgcccugaacgugaccaugcccaacaacgaggaguucgacaagcuguacaucuggggcgugcaccaccccgggaccuacaacgaccagaucucccucuacgcgcaggccucgggccggaucaccgucagcacgaagcgcucccagcagaccgugaucccgaacaucggcucgcggccccgcgugcgggacauccccucccgcaucagcaucuacuggaccaucgucaagcccggggacauccugcugaucaacuccaccggcaaccucaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgugaagcagaacacccugaagcuggcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccucaaguccacccaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacacgaucgaccugaccgacagcgagaugaacaagcuguucgagaucaccaagaagcagcuccgggagaacgccgaggacaugggcaacgggugcuucaagaucuaccacaagugcgacaacgcgugcaucggcuccauccgcaacgggaccuacgaccacgacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 7027 - RNA, 1701 nt, Artificial Sequence; identical to SEQ ID NO: 7024
  derived and/or modified CDS sequence (AUadapt) from InfluenzaA__AEG65483__HA

SEQ ID NO: 7028 - RNA, 1701 nt, Artificial Sequence; identical to SEQ ID NO: 7024
  derived and/or modified CDS sequence (AUadapt) from InfluenzaA__AEG65494__HA

SEQ ID NO: 7029 - RNA, 1701 nt, Artificial Sequence; identical to SEQ ID NO: 7024
  derived and/or modified CDS sequence (AUadapt) from InfluenzaA__AEG65505__HA

SEQ ID NO: 7030 - RNA, 1701 nt, Artificial Sequence; identical to SEQ ID NO: 7024
  derived and/or modified CDS sequence (AUadapt) from InfluenzaA__AEG65516__HA

SEQ ID NO: 7031 - RNA, 1701 nt, Artificial Sequence; identical to SEQ ID NO: 7024
  derived and/or modified CDS sequence (AUadapt) from InfluenzaA__AEG65527__HA

SEQ ID NO: 7032 - RNA, 1701 nt, Artificial Sequence; identical to SEQ ID NO: 7024
  derived and/or modified CDS sequence (AUadapt) from InfluenzaA__AEG65538__HA

SEQ ID NO: 7033 - RNA, 1701 nt, Artificial Sequence
  derived and/or modified CDS sequence (AUadapt) from InfluenzaA__AEG65560__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugaaguccgacgcccccaucggcaagugcaacagcgagugcaucacgcccaacggguccauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacacgaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 7034 - RNA, 1701 nt, Artificial Sequence; identical to SEQ ID NO: 7033
  derived and/or modified CDS sequence (AUadapt) from InfluenzaA__AEG65571__HA

SEQ ID NO: 7035 - RNA, 1701 nt, Artificial Sequence; identical to SEQ ID NO: 7033
  derived and/or modified CDS sequence (AUadapt) from InfluenzaA__AEG65582__HA

SEQ ID NO: 7036 - RNA, 1701 nt, Artificial Sequence; identical to SEQ ID NO: 7033
  derived and/or modified CDS sequence (AUadapt) from InfluenzaA__AEG65593__HA

SEQ ID NO: 7037 - RNA, 1701 nt, Artificial Sequence
  derived and/or modified CDS sequence (AUadapt) from InfluenzaA__AEG65604__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacaacucguucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccuccggcaagaucaccgucucgacgaagcggucgcagcagaccgugaucccgaacaucggcucccgcccccgggugcgcgacauccccagccggaucuccaucuacuggaccaucgucaagcccggggacauccugcucaucaacucgaccggcaaccugaucgccccgcgcggguacuucaagauccgguccggcaagagcuccaucaugcgcucggacgcccccaucggcaagugcaacuccgagugcaucacgcccaacgggucgauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggaccuacgaccacgacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 7038 - RNA, 1701 nt, Artificial Sequence
  derived and/or modified CDS sequence (AUadapt) from InfluenzaA__AEG65626__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgcaaguccaacaacucguucuucucccggcugaacuggcucacgcaccugaaguucaaguaccccgcccugaacgugaccaugcccaacaacaagaaguucgacaagcucuacaucuggggcguccaccaccccgggaccgacaacgaccagaucucgcuguacgcgcaggccuccggccgcaucaccgugagcacgaagcggucgcagcagaccgugaucccgaacaucggcucccgcccccggguccgcgacauccccucgcggaucuccaucuacuggaccaucgugaagcccggggacaugcugcucaucaacagcaccggcaaccugaucgccccgcgcggguacuucaagauccgguccggcaagucguccaucaugcgcucggacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacacgaagaucgaccuguggucguacaacgccgagcuccugguggcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggacguacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 7039 - RNA, 1701 nt, Artificial Sequence
  derived and/or modified CDS sequence (AUadapt) from InfluenzaA__AEG65637__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgcaaguccaacaacucguucuucucccggcugaacuggcucacgcaccugaaguucaaguaccccgcccugaacgugaccaugcccaacaacaagaaguucgacaagcucuacaucuggggcguccaccaccccgggaccgacaacgaccagaucucgcuguacgcgcaggccuccggccgcaucaccgugagcacgaagcggucgcagcagaccgugaucccgaacaucggcucccgcccccggguccgcgacauccccucgcggaucuccaucuacuggaccaucgugaagcccggggacaugcugcucaucaacagcaccggcaaccugaucgccccgcgcggguacuucaagauccgguccggccgcucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 7040 - RNA, 1701 nt, Artificial Sequence; identical to SEQ ID NO: 276
  derived and/or modified CDS sequence (AUadapt) from InfluenzaA__AEG65648__HA

SEQ ID NO: 7041 - RNA, 1701 nt, Artificial Sequence; identical to SEQ ID NO: 2040
  derived and/or modified CDS sequence (AUadapt) from InfluenzaA__AEG65659__HA

SEQ ID NO: 7042 - RNA, 1701 nt, Artificial Sequence; identical to SEQ ID NO: 2040
  derived and/or modified CDS sequence (AUadapt) from InfluenzaA__AEG65670__HA

SEQ ID NO: 7043 - RNA, 1701 nt, Artificial Sequence; identical to SEQ ID NO: 2040
  derived and/or modified CDS sequence (AUadapt) from InfluenzaA__AEG65681__HA

SEQ ID NO: 7044 - RNA, 1701 nt, Artificial Sequence; identical to SEQ ID NO: 7015
  derived and/or modified CDS sequence (AUadapt) from InfluenzaA__AEG65692__HA

SEQ ID NO: 7045 - RNA, 1701 nt, Artificial Sequence; identical to SEQ ID NO: 875
  derived and/or modified CDS sequence (AUadapt) from InfluenzaA__AEG65703__HA

SEQ ID NO: 7046 - RNA, 1701 nt, Artificial Sequence
  derived and/or modified CDS sequence (AUadapt) from InfluenzaA__AEG65747__HA
augaagaccaucaucgcccugucguacauccucugccugguguucgcccagaagcugcccggcaacgacaacuccaccgcgacgcucugccuggggcaccacaccgucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcucgaaggccuacuccaacugcuaccccuacgacgugccggacuacgccagccugcggucccucgucgcgucguccggcacccuggaguucaacaacgagagcuucaacuggaccggggugacccagaacggcacguccucggccugcaagcgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcccaggcgagcgggcggaucacgguguccaccaagcgcucgcagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacucggaggggaccggccaggccgccgaccugaaguccacccaggccgcgaucaaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacucggagaugaacaagcuguucgagcggacgaagaagcagcugcgcgagaacgccgaggacauggggaacggcugcuucaagaucuaccacaagugcgacaacgccugcaucggguccauccgcaacggcaccuacgaccacgacgucuaccgggacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 7047 - RNA, 1701 nt, Artificial Sequence
  derived and/or modified CDS sequence (AUadapt) from InfluenzaA__AEG65758__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccgggggcaucugcgacucgccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgccggucgaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugagcacgaagcgcucgcagcagaccgugaucccgaacaucggcucccggccccgcguccggaacauccccucgcgcaucuccaucuacuggaccaucgugaagcccggggacauccugcucaucaacagcaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagucgacccaggcggccaucaaccagaucaacggcaagcugaaccggcugaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 7048 - RNA, 1701 nt, Artificial Sequence; identical to SEQ ID NO: 526
  derived and/or modified CDS sequence (AUadapt) from InfluenzaA__AEG65769__HA

SEQ ID NO: 7049 - RNA, 1701 nt, Artificial Sequence
  derived and/or modified CDS sequence (AUadapt) from InfluenzaA__AEG65780__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgacaagaucgaggugacgaacgccaccgagcugguccagucguccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgucgcugcggucccucgucgccgccagcggcacgcuggaguucaacaacgaguccuucaacuggaccggggugacccagaacggcaccucguccgccugcauccgccggucgaacaacuccuucuucagccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccaggccgccgggcggaucaccguguccacgaagcgcucgcagcaggccgugaucccgaacaucggcucccggccccgcguccggaacauccccucgcgcgugucgaucuacuggaccaucgugaagcccggcgacauccugcucaucaacuccaccgggaaccugaucgcgccgcggggcuacuucaagauccgcagcgggaaguccucgaucaugcgguccgacgcccccaucggcaagugcaacucggccugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgcgaucgccggguucaucgagaacggcugggagggcauggucgacgggugguacggcuuccgccaccagaacagcgaggggcggggccaggccgccgaccugaaguccacgcaggccgcgaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcgcucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 7050 - RNA, 1701 nt, Artificial Sequence
  derived and/or modified CDS sequence (AUadapt) from InfluenzaA__AEG65813__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcucgcggccccgcguccggaacauccccucgcgcguguccaucuacuggaccaucgugaagcccggcgacauccugcucaucaacagcaccgggaaccugaucgccccgcggggcuacuucaagauccgcuccgggaaguccuccaucaugcggucggacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaccgaccuguggucguacaacgcggagcuccuggucgcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 7051 - RNA, 1701 nt, Artificial Sequence
  derived and/or modified CDS sequence (AUadapt) from InfluenzaA__AEG79801__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccgcgagggccggaugaacuacuacuggacccugguggagcccggggacaagaucaccuucgaggcgacgggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcgccucgcgacgggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgucccuggugcucguggucagccugggggccaucucguucuggaugugcuccaacggcagccugcagugccgcaucugcaucuga

SEQ ID NO: 7052 - RNA, 1701 nt, Artificial Sequence
  derived and/or modified CDS sequence (AUadapt) from InfluenzaA__AEG79807__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggagaacagcuaccccaagcuguccaagucguacaucaacgacaaggggaaggaggugcugguccucuggggcauccaccaccccagcaccacggccgaccagcaguccaucuaccagaacgccgacgccuacguguucguggggaccucgcgguacuccaagaaguucaagcccgagaucgccauccgcccgaagguccgggaccaggagggccgcaugaacuacuacuggacccugguggagcccggcgacaagaucaccuucgaggcgacggggaaccugguggucccccgguacgccuucgccauggagcgcaacgccggcucggggaucaucaucuccgacacccccgugcacgacugcaacacgaccugccagaccccgaagggcgccaucaacaccagccuccccuuccagaacauccaccccaucaccaucggcaagugccccaaguacgugaaguccaccaagcugcggcuggcgacggggcuccgcaacgucccgucgauccagucccggggccuguucggggccaucgccggcuucaucgagggcggguggaccggcaugguggacgggugguacggcuaccaccaccagaacgagcaggggagcggcuacgccgccgaccugaaguccacccagaacgcgaucgacaagaucaccaacaaggugaacucggucaucgagaagaugaacacgcaguucaccgccguggggaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcuggagagcacccgcaucuaccagauccucgcgaucuacuccaccgucgccucgucccuggugcugguggucagccucggcgccaucucguucuggaugugcuccaacgggagccugcagugccggaucugcaucuga

SEQ ID NO: 7053 - RNA, 1701 nt, Artificial Sequence
  derived and/or modified CDS sequence (AUadapt) from InfluenzaA__AEG79835__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgaucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 7054 - RNA, 1701 nt, Artificial Sequence
  derived and/or modified CDS sequence (AUadapt) from InfluenzaA__AEH59363__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcaggccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagucgacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgcgaggagaucgacggcgugaagcuggagagcacccggaucuaccagauccuggccaucuacuccaccgucgccucgagccucgugcugguggucucccugggggccaucucguucuggaugugcuccaacggcagccuccagugccgcaucugcaucuga

SEQ ID NO: 7055 - RNA, 1701 nt, Artificial Sequence
  derived and/or modified CDS sequence (AUadapt) from InfluenzaA__AEH59367__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacugggcgcugguggagcccggggacaagaucaccuucgaggccaccggcaaccucguggucccccgguacgccuucgccauggagcgcaacgccgggucgggcaucaucaucuccgacacgcccgugcacgacugcaacacgaccugccagaccccgaagggcgcgaucaacaccagccugcccuuccagaacauccaccccaucaccaucgggaagugccccaaguacgugaaguccaccaagcugcggcucgccaccggccugcgcaacgucccgucgauccagucccgggggcuguucggcgccaucgccggguucaucgagggcggcuggacggggaugguggacggcugguacggguaccaccaccagaacgagcagggcagcggguacgccgcggaccucaaguccacccagaacgccaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgucccuggugcucguggucagccugggggccaucucguucuggaugugcuccaacggcagccugcagugccggaucugcaucuga

SEQ ID NO: 7056 - RNA, 1701 nt, Artificial Sequence
  derived and/or modified CDS sequence (AUadapt) from InfluenzaA__AEH59369__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaaggccagcuccuggcccaaccacgacucgaacaagggggucaccgccgccugcccgcacgcgggcgccaagggguucuacaagaaccugaucuggcucgugaagaagggcaacuccuaccccaagcugucgaaguccuacaucaacgacaaggggaaggaggugcugguccucuggggcauccaccaccccagcaccaccgccgaccagcagucgcuguaccagaacgccgacacguacguguucgugggcaccucccgguacagcaagaaguucaagcccgagaucgccauccgcccgaagguccgggaccaggaggggcgcaugaacuacuacuggacccugguggagcccggcgacaagaucaccuucgaggcgacggggaaccucguggucccccgguacgccuucgccauggagcgcaacgccggcuccggcaucaucaucucggacacccccgugcacgacugcaacacgaccugccagaccccgaagggggccaucaacaccucccugcccuuccagaacauccaccccaucaccaucggcaagugccccaaguacgucaagucgaccaagcugcggcucgcgacggggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacucgaccgucgccuccagccuggugcucguggucucccugggcgccaucucguucuggaugugcagcaacggcucccugcagugccggaucugcaucuga

SEQ ID NO: 7057 - RNA, 1701 nt, Artificial Sequence; identical to SEQ ID NO: 7054
  derived and/or modified CDS sequence (AUadapt) from InfluenzaA__AEH59371__HA

SEQ ID NO: 7058 - RNA, 1701 nt, Artificial Sequence
  derived and/or modified CDS sequence (AUadapt) from InfluenzaA__AEH59373__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcgaggucgcgccccugcaccucggcaagugcaacaucgccggguggauccugggcaacccggagugcgagucgcuguccaccgccagcuccuggucguacaucguggagaccuccucguccgacaacgggacgugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggggcgaagggcuucuacaagaaccugaucuggcucgugaagaaggggaacuccuaccccaagcugucgaaguccuacaucaacgacaagggcaaggaggugcugguccucugggggauccaccaccccagcaccacggccgaccagcagucgcuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucucggacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgcgaucgccggguucaucgagggcggcuggaccgggaugguggacggcugguacggguaccgccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagcggcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 7059 - RNA, 1701 nt, Artificial Sequence; identical to SEQ ID NO: 7054
  derived and/or modified CDS sequence (AUadapt) from InfluenzaA__AEH59375__HA

SEQ ID NO: 7060 - RNA, 1701 nt, Artificial Sequence
  derived and/or modified CDS sequence (AUadapt) from InfluenzaA__AEH59379__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 7061 - RNA, 1701 nt, Artificial Sequence; identical to SEQ ID NO: 7054
  derived and/or modified CDS sequence (AUadapt) from InfluenzaA__AEH59381__HA

SEQ ID NO: 7062 - RNA, 1701 nt, Artificial Sequence
  derived and/or modified CDS sequence (AUadapt) from InfluenzaA__AEH59383__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaagggguucuacaagaaccugaucuggcucgugaagaagggcaacuccuaccccaagcugagcaucuccuacaucaacgacaaggggaaggaggugcugguccucuggggcauccaccaccccucgaccacggccgaccagcagagccuguaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagucgcggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 7063 - RNA, 1701 nt, Artificial Sequence
  derived and/or modified CDS sequence (AUadapt) from InfluenzaA__AEH59385__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacaucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 7064 - RNA, 1701 nt, Artificial Sequence; identical to SEQ ID NO: 7054
  derived and/or modified CDS sequence (AUadapt) from InfluenzaA__AEH59387__HA

SEQ ID NO: 7065 - RNA, 1701 nt, Artificial Sequence
  derived and/or modified CDS sequence (AUadapt) from InfluenzaA__AEH59393__HA
augaaggccauccugguggucauccucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccagcaccacggccgaccagcagucgcucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 7066 - RNA, 1701 nt, Artificial Sequence
  derived and/or modified CDS sequence (AUadapt) from InfluenzaA__AEH59397__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccucgcacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgucgauccagucccgcggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacucggucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgagaacgggugcuucgaguucuaccacaagugcgacaacacgugcauggaguccgugaagaacggcaccuacgacuaccccaaguacucggaggaggccaagcucaaccgcgaggagaucgacggggugaagcuggaguccacccggaucuaccagauccuggcgaucuacagcaccgucgccucgucccucgugcugguggucagccugggcgccaucuccuucuggaugugcagcaacgggucccuccagugccgcaucugcaucuga

SEQ ID NO: 7067 - RNA, 1701 nt, Artificial Sequence
  derived and/or modified CDS sequence (AUadapt) from InfluenzaA__AEH59399__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggaccaucguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 7068 - RNA, 1701 nt, Artificial Sequence
  derived and/or modified CDS sequence (AUadapt) from InfluenzaA__AEH59403__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggcccccggcgacaagaucacguucgaggcgaccgggaaccucguggucccccgguacgccuucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgcgaccgggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagucgacccagaacgcgaucgacaagaucacgaacaaggugaacuccgucaucgagaagaugaacacccaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacucgaccgucgccuccagccuggugcucguggucucccugggcgccaucucguucuggaugugcagcaacggcucccugcagugccggaucugcaucuga

SEQ ID NO: 7069 - RNA, 1701 nt, Artificial Sequence
  derived and/or modified CDS sequence (AUadapt) from InfluenzaA__AEH59407__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccagcaccacggccgaccagcagucgcucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 7070 - RNA, 1701 nt, Artificial Sequence; identical to SEQ ID NO: 7069
  derived and/or modified CDS sequence (AUadapt) from InfluenzaA__AEH59409__HA

SEQ ID NO: 7071 - RNA, 1701 nt, Artificial Sequence
  derived and/or modified CDS sequence (AUadapt) from InfluenzaA__AEH59411__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggaccgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 7072 - RNA, 1701 nt, Artificial Sequence
  derived and/or modified CDS sequence (AUadapt) from InfluenzaA__AEH59413__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucaacuacgaggagcuccgggagcagcugagcuccgugucguccuucgagcgcuucgagaucuuccccaagacgagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccuccaaguacagcaagaaguucaagcccgagaucgccguccggccgaaggugcgcgaccaggagggccggaugaacuacuacuggacgcugguggagcccggggacaagaucaccuucgaggcgaccggcaaccuccuggucccccgcuacgccuucgccauggagcggaacgccggguccggcaucaucaucucggacacccccgugcacgacugcaacacgaccugccagaccccggagggcgccaucaacaccucccugcccuuccagaacauccaccccaucacgaucgggaagugccccaaguacgucaagagcaccaagcuccgccuggcgaccggccugcggaacgugccguccauccagucgcgcggccucuucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcggaucgagaaccugaacaagaaggucgacgacggcuuccuggacaucuggacguacaacgccgagcugcucgugcugcuggagaacgagcgcacccucgacuaccacgacucgaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagucgacccggaucuaccagauccuggcgaucuacuccaccgucgccagcucgcucgugcugguggucucccugggggccaucagcuucuggaugugcuccaacggcagccuccagugccgcaucugcaucuga

SEQ ID NO: 7073 - RNA, 1701 nt, Artificial Sequence
  derived and/or modified CDS sequence (AUadapt) from InfluenzaA__AEH59585__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacgguggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacucgaccguggcguccagccuggugcucgucgugucgcugggggccaucuccuucuggaugugcagcaacggcucccugcagugccggaucugcaucuga

SEQ ID NO: 7074 - RNA, 1701 nt, Artificial Sequence
  derived and/or modified CDS sequence (AUadapt) from InfluenzaA__AEH59587__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugagcuccuucgagcgcuucgagaucuuccccaagaccucguccuggcccaaccacgagagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguucauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacgguggucggcaaggaguucaacccccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggccaucuacagcaccguggcguccucgcuggugcucgucgugagccugggggccaucuccuucuggaugugcagcaacggcucccugcagugccggaucugcaucuga

SEQ ID NO: 7075 - RNA, 1701 nt, Artificial Sequence; identical to SEQ ID NO: 4078
  derived and/or modified CDS sequence (AUadapt) from InfluenzaA__AEH59589__HA

SEQ ID NO: 7076 - RNA, 1701 nt, Artificial Sequence
  derived and/or modified CDS sequence (AUadapt) from InfluenzaA__AEH59591__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacgguggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 7077 - RNA, 1701 nt, Artificial Sequence
  derived and/or modified CDS sequence (AUadapt) from InfluenzaA__AEH59593__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgagagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagcaucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 7078 - RNA, 1701 nt, Artificial Sequence; identical to SEQ ID NO: 3712
  derived and/or modified CDS sequence (AUadapt) from InfluenzaA__AEH59595__HA

SEQ ID NO: 7079 - RNA, 1701 nt, Artificial Sequence; identical to SEQ ID NO: 4078
  derived and/or modified CDS sequence (AUadapt) from InfluenzaA__AEH59597__HA

SEQ ID NO: 7080 - RNA, 1701 nt, Artificial Sequence; identical to SEQ ID NO: 7073
  derived and/or modified CDS sequence (AUadapt) from InfluenzaA__AEH59599__HA

SEQ ID NO: 7081 - RNA, 1701 nt, Artificial Sequence
  derived and/or modified CDS sequence (AUadapt) from InfluenzaA__AEH59601__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaacugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacgguggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 7082 - RNA, 1701 nt, Artificial Sequence; identical to SEQ ID NO: 3712
  derived and/or modified CDS sequence (AUadapt) from InfluenzaA__AEH59604__HA

SEQ ID NO: 7083 - RNA, 1701 nt, Artificial Sequence; identical to SEQ ID NO: 3712
  derived and/or modified CDS sequence (AUadapt) from InfluenzaA__AEH59614__HA

SEQ ID NO: 7084 - RNA, 1701 nt, Artificial Sequence
  derived and/or modified CDS sequence (AUadapt) from InfluenzaA__AEH59624__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcaguccuucuaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccugguggucccccgguacgccuucgccauggagcgcaacgccgggagcggcaucaucaucuccgacacgccggugcacgacugcaacacgaccugccagacccccaagggcgccaucaacaccucgcuccccuuccagaacauccaccccaucaccaucgggaagugcccgaaguacgugaaguccaccaagcugcggcuggcgaccggccuccgcaacguccccagcauccagucccgggggcuguucggcgccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacucgaccgucgccuccagccuggugcugguggucucgcucggggccaucuccuucuggaugugcagcaacggcucccugcagugccggaucugcaucuga

SEQ ID NO: 7085 - RNA, 1698 nt, Artificial Sequence
  derived and/or modified CDS sequence (AUadapt) from InfluenzaA__AEH77259__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagauguucccgaaggaguccagcuggcccaaccacacggucaccgggguguccgccagcugcucccacaacggcgagucguccuucuaccgcaaccugcuguggcucaccgagaagaacgggcuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacucgcggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccagggcgcgaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagucgaugggggucuaccagauccuggcgaucuacagcaccguggccuccagccugguguuccucgucucccugggcgccaucagcuucuggaugugcuccaacggcagccugcagugccggaucugcaucuga

SEQ ID NO: 7086 - RNA, 1701 nt, Artificial Sequence; identical to SEQ ID NO: 62
  derived and/or modified CDS sequence (AUadapt) from InfluenzaA__AEH77270__HA

SEQ ID NO: 7087 - RNA, 1701 nt, Artificial Sequence; identical to SEQ ID NO: 277
  derived and/or modified CDS sequence (AUadapt) from InfluenzaA__AEH77279__HA

SEQ ID NO: 7088 - RNA, 1701 nt, Artificial Sequence; identical to SEQ ID NO: 4016
  derived and/or modified CDS sequence (AUadapt) from InfluenzaA__AEI29215__HA

SEQ ID NO: 7089 - RNA, 1701 nt, Artificial Sequence; identical to SEQ ID NO: 116
  derived and/or modified CDS sequence (AUadapt) from InfluenzaA__AEI29225__HA

SEQ ID NO: 7090 - RNA, 1701 nt, Artificial Sequence
  derived and/or modified CDS sequence (AUadapt) from InfluenzaA__AEI29591__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcucgcucgucgccuccagcggcacgcuggaguucaucaacgagggguucaacuggaccggcgugacccagaacgggggcuccucggccugcaagcgggggcccgacaacggcuucuucucccgccugaacuggcucuacaagagcggcuccaccuaccccgugcagaacgucacgaugcccaacaacgacaacucggacaagcuguacaucuggggcgugcaccacccguccaccgacaaggagcagaccaaccuguacgugcaggccucggggaaggucaccguguccacgaagcggagccagcagaccgugauccccaacgucgggucgcgccccugggugcggggccucuccucgcgcguguccaucuacuggaccaucgucaagcccggcgacauccuggugaucaacagcaacgggaaccugaucgcgccgcggggcuacuacaagaugcgcaccgggaaguccucgaucaugcgguccgacgcccccaucggcacgugcagcuccgagugcaucacccccaacgggucgauccccaacgacaagccguuccagaacgugaacaagaucaccuacggcgccugccccaaguacgucaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcucgauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccgcugcaacaucugcaucuga

SEQ ID NO: 7091 - RNA, 1701 nt, Artificial Sequence; identical to SEQ ID NO: 277
  derived and/or modified CDS sequence (AUadapt) from InfluenzaA__AEI54347__HA

SEQ ID NO: 7092 - RNA, 1701 nt, Artificial Sequence; identical to SEQ ID NO: 363
  derived and/or modified CDS sequence (AUadapt) from InfluenzaA__AEI54358__HA

SEQ ID NO: 7093 - RNA, 1701 nt, Artificial Sequence; identical to SEQ ID NO: 878
  derived and/or modified CDS sequence (AUadapt) from InfluenzaA__AEI54369__HA

SEQ ID NO: 7094 - RNA, 1701 nt, Artificial Sequence; identical to SEQ ID NO: 761
  derived and/or modified CDS sequence (AUadapt) from InfluenzaA__AEI54380__HA

SEQ ID NO: 7095 - RNA, 1701 nt, Artificial Sequence; identical to SEQ ID NO: 7024
  derived and/or modified CDS sequence (AUadapt) from InfluenzaA__AEI54391__HA

SEQ ID NO: 7096 - RNA, 1701 nt, Artificial Sequence
  derived and/or modified CDS sequence (AUadapt) from InfluenzaA__AEI54402__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcuacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 7097 - RNA, 1701 nt, Artificial Sequence; identical to SEQ ID NO: 2173
  derived and/or modified CDS sequence (AUadapt) from InfluenzaA__AEI54413__HA

SEQ ID NO: 7098 - RNA, 1701 nt, Artificial Sequence; identical to SEQ ID NO: 526
  derived and/or modified CDS sequence (AUadapt) from InfluenzaA__AEI54424__HA

SEQ ID NO: 7099 - RNA, 1701 nt, Artificial Sequence
  derived and/or modified CDS sequence (AUadapt) from InfluenzaA__AEI54446__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgagaucugcaacucgccccaccagauccucgacggggagaacugcacccugaucgacgcccugcucggcgacccccagugcgacggguuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggcgugacccagaacgggaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccggccggaucaccgugucgacgaagcgcucccagcaggccgugaucccgaacaucgggagccggccccgcguccggaacauccccucgcgcguguccaucuacuggaccaucgugaagcccggcgacauccugcucaucaacucgaccggcaaccugaucgccccgcggggguacuucaagauccgcuccggcaagagcuccaucaugcggucggacgcgcccaucgggaagugcaacuccgccugcaucacccccaacggcucgauccccaacgacaagccguuccagaacgucaaccgcaucacguacggcgccugcccccgguacgugaagcagaacacccugaagcucgccaccgggaugcgcaacgugcccgagaagcagacccggggcaucuucggggccaucgcgggcuucaucgagaacgggugggagggcauggucgacggcugguacggguuccgccaccagaacuccgagggccgggggcaggccgccgaccugaaguccacgcaggccgccaucgaccagaucaacggcaagcugaaccgccucaucgggaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgccugcaucggcucgauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgcccugcucggcuucaucaugugggccugccagaagggcaacauccggugcaacaucugcaucuga

SEQ ID NO: 7100 - RNA, 1701 nt, Artificial Sequence
  derived and/or modified CDS sequence (AUadapt) from InfluenzaA__AEI54457__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 7101 - RNA, 1701 nt, Artificial Sequence; identical to SEQ ID NO: 5778
  derived and/or modified CDS sequence (AUadapt) from InfluenzaA__AEI54468__HA

SEQ ID NO: 7102 - RNA, 1701 nt, Artificial Sequence; identical to SEQ ID NO: 5778
  derived and/or modified CDS sequence (AUadapt) from InfluenzaA__AEI54479__HA

SEQ ID NO: 7103 - RNA, 1701 nt, Artificial Sequence; identical to SEQ ID NO: 7100
  derived and/or modified CDS sequence (AUadapt) from InfluenzaA__AEI54490__HA

SEQ ID NO: 7104 - RNA, 1701 nt, Artificial Sequence; identical to SEQ ID NO: 7099
  derived and/or modified CDS sequence (AUadapt) from InfluenzaA__AEI54501__HA

SEQ ID NO: 7105 - RNA, 1701 nt, Artificial Sequence
  derived and/or modified CDS sequence (AUadapt) from InfluenzaA__AEI59979__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugucgacgaagcgcucccagcagaccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccggcaagagcuccaucaugcggucggacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucgagaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaagggcaacauccggugcaacaucugcaucuga

SEQ ID NO: 7106 - RNA, 1698 nt, Artificial Sequence; identical to SEQ ID NO: 6202
  derived and/or modified CDS sequence (AUadapt) from InfluenzaA__AEI59990__HA

SEQ ID NO: 7107 - RNA, 1698 nt, Artificial Sequence; identical to SEQ ID NO: 6204
  derived and/or modified CDS sequence (AUadapt) from InfluenzaA__AEI60001__HA

SEQ ID NO: 7108 - RNA, 1701 nt, Artificial Sequence
  derived and/or modified CDS sequence (AUadapt) from InfluenzaA__AEI60012__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgcuccucgaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcgcaucaccgugucgacgaagcggagccagcagaccgugaucccgaacaucggcucccgcccccggguccgcaacauccccucgcggaucuccaucuacuggaccaucgugaagcccggcgacauccugcucaucaacagcaccgggaaccugaucgccccgcgcggcuacuucaagauccgguccgggaaguccuccaucaugcgcucggacgcccccaucggcaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgaggucgagggcaagauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacaaccacgacgucuaccgcgacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 7109 - RNA, 1701 nt, Artificial Sequence; identical to SEQ ID NO: 2679
  derived and/or modified CDS sequence (AUadapt) from InfluenzaA__AEI60023__HA

SEQ ID NO: 7110 - RNA, 1701 nt, Artificial Sequence
  derived and/or modified CDS sequence (AUadapt) from InfluenzaA__AEI60034__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 7111 - RNA, 1701 nt, Artificial Sequence
  derived and/or modified CDS sequence (AUadapt) from InfluenzaA__AEI60045__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaugaacgaccagaucgaggugaccaacgccacggagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacccuggaguucaacaacgagucguucaacuggacgggggugacccagaacggcaccuccagcgccugcauccgccgguccaagaacucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccucggggcggaucaccguguccaccaagcgcagccagcagacggccaucccgaacaucggcuaccggccccgcgugcggaacauccccucgcgcaucuccaucuacuggaccaucgucaagcccggcgacauccugcucaucaacagcaccgggaaccugaucgccccgcggggcuacuucaagauccgcuccgggaaguccuccaucaugcggucggacgcccccaucggcaagugcaacuccgagugcaucacccccaacggcagcauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 7112 - RNA, 1701 nt, Artificial Sequence
  derived and/or modified CDS sequence (AUadapt) from InfluenzaA__AEI60086__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 7113 - RNA, 1701 nt, Artificial Sequence
  derived and/or modified CDS sequence (AUadapt) from InfluenzaA__AEI60109__HA
augaagaccaccaucgcccugucguacauccucugccugguguucgcccagaagcugcccggcaacgacaacuccacggcgacccucugccuggggcaccacgccgucccgaacggcacccuggugaagaccaucacgaacgaccagaucgaggugaccaacgccaccgagcucguccagaacucguccaccgggcgcaucugcgacagcccccaccagauccuggacggcgagaacugcacgcugaucgacgcccuccugggggacccccacugcgacggcuuccagaacaaggagugggaccuguucguggagcgguccaaggccuacucgaacugcuaccccuacaacgugccggacuacgucucccuccgcagccugguggcguccucgggcacccuggaguucaacaacgaguccuucaacuggaccgggguggcccaggacggcagcuccuacgccugcaagcggcgcucgaacaaguccuucuucucgcggcucaacuggcugcaccagcugaacuacaaguaccccgcccucaacgucaccaugcccaacaacgagaacuucgacaagcuguacaucuggggcgugcaccaccccgggacggacuccgaccagaucagccuguacgcgcaggccuccgggcgcgugaccgucucgaccaagcggagccagcagaccgugaucccgaacaucggcuaccgccccugggugcggggcgucuccucgaucaucuccaucuacuggacgaucgugaagcccggggacauccuccugaucaacagcaccggcaaccugaucgcgccccgcggguacuucaagauccgguccggcaagucguccaucaugcgcucggacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugaaggacggcugguacggguuccggcaccagaacuccgagggcaccgggcaggccgccgacaucaagucgacgcaggccgcgaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagcgcaccaagaagcagcugcgggagaacgccgaggacauggggaacggcugcuucaagaucuaccacaagugcgacaacacgugcaucgggucgauccgcaacggcaccuacgaccacgacguguaccgcgacgaggcccucaacaaccgguuccacaucaagggggucgagcugaaguccggcuacaaggacuggauccuguggaucagcuucgcgaccuccugcuuccuccugugcaucgugcugcucggcuucaucaugugggccugccagaaggggaacauccgcugcaacaucugcaucuga

SEQ ID NO: 7114 - RNA, 1701 nt, Artificial Sequence
  derived and/or modified CDS sequence (AUadapt) from InfluenzaA__AEI86734__HA
augaaggccauccuggugguccuccuguacaccuucgccaccgcgaacgccgacacgcugugcgugggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucggucuccagcuucgagcgcuucgagaucuuccccaagaccuccucguggcccaaccacgacuccaacaagggggugaccgccgccugcccgcacgccggcgccaagagcuucuaccggaaccugaucuggcucgugaagaaggggaacuccuaccccaagcugucgaaguccuacaucaacgacaagggcaaggagguccuggugcucugggggauccaccaccccagcaccucggccgaccagcagucccuguaccagaacgccgacacguacguguucgucggcaccucgcgcuacuccaagaaguucaagcccgagaucgccauccggccgaaggugcgcgaccaggagggccggaugaacuacuacuggacccugguggagcccggggacaagaucaccuucgaggccacgggcaaccucgucgugccccgcuacgcguucgccauggagcggaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgucaaguccaccaagcugcgccucgccacgggccugcggaacgugccgagcauccagucccgcgggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggucaacagcgugaucgagaagaugaacacgcaguucaccgcggucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacuccaacgucaagaaccucuacgagaaggugcggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgucaagcucgaguccacccggaucuaccagauccuggccaucuacucgaccguggcguccagccuggugcucgucgugucgcugggggccaucuccuucuggaugugcagcaacggcucccugcagugccgcaucugcaucuga

SEQ ID NO: 7115 - RNA, 1701 nt, Artificial Sequence
  derived and/or modified CDS sequence (AUadapt) from InfluenzaA__AEI86764__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7116 - RNA, 1701 nt, Artificial Sequence; identical to SEQ ID NO: 7115
  derived and/or modified CDS sequence (AUadapt) from InfluenzaA__AEI86774__HA

SEQ ID NO: 7117 - RNA, 1701 nt, Artificial Sequence
  derived and/or modified CDS sequence (AUadapt) from InfluenzaA__AEI86784__HA
augaaggugauccuggucgugcuccuguacaccuucgccaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucaagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 7118 - RNA, 1701 nt, Artificial Sequence
  derived and/or modified CDS sequence (AUadapt) from InfluenzaA__AEI86794__HA
augaagaccauccuggugguccuccuguacaccuucgccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcaacuucaucgacuacgaggagcuccgggagcagcugucguccgugagcuccuucgagcgcuucgagaucuuccccaagaccucguccuggcccgaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccuccaaguacagcaagaaguucaagcccgagaucgccauccggccgaagguccgcgaccaggagggccggaugaacuacuacuggacccugguggagcccggggacaagaucaccuucgaggccacgggcaaccucguggcgccccgcuacgccuucgccauggagcggaacgccggguccggcaucaucaucucggacacccccguccacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 7119 - RNA, 1701 nt, Artificial Sequence
  derived and/or modified CDS sequence (AUadapt) from InfluenzaA__AEI86804__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugauguggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccgccgucgccucgagccuggugcucguggucucccugggggccaucucguucuggaugugcuccaacggcagccugcagugccggaucugcaucuga

SEQ ID NO: 7120 - RNA, 1701 nt, Artificial Sequence; identical to SEQ ID NO: 7115
  derived and/or modified CDS sequence (AUadapt) from InfluenzaA__AEI86814__HA

SEQ ID NO: 7121 - RNA, 1701 nt, Artificial Sequence
  derived and/or modified CDS sequence (AUadapt) from InfluenzaA__AEI86824__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccaggacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7122 - RNA, 1701 nt, Artificial Sequence
  derived and/or modified CDS sequence (AUadapt) from InfluenzaA__AEI86834__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugagcuccuucgagcgcuucgagaucuuccccaagaccucguccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagccgcaaguucaagcccgagaucgccauccggccgaagguccgcgaccaggagggccggaugaacuacuacuggacccugguggagcccggggacaagaucaccuucgaggcgaccggcaaccucguggcgccccgcuacgccuucgccauggagcggaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcgccucgccaccggccugcggaacgugccguccauccagucgcgcgggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgcgaggagaucgacggcgugaagcucgagagcacccggaucuaccagauccuggccaucuacuccaccguggccucgagccugguccucguggugucccugggggccaucucguucuggaugugcuccaacggcagccugcagugccgcaucugcaucuga

SEQ ID NO: 7123 - RNA, 1701 nt, Artificial Sequence; identical to SEQ ID NO: 88
  derived and/or modified CDS sequence (AUadapt) from InfluenzaA__AEI86854__HA

SEQ ID NO: 7124 - RNA, 1701 nt, Artificial Sequence
  derived and/or modified CDS sequence (AUadapt) from InfluenzaA__AEI86864__HA
augaaggccauccugguggcccuccuguacaccuucgcgaccgccaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggugaccgccgccugcccgcacgcgggcgccaaguccuucuacaagaaccugaucuggcucgucaagaaggggaacucguaccccaagcuguccaagagcuacaucaacgacaagggcaaggaggugcuggugcucugggggauccaccaccccucgaccacggccgaccagcagucccuguaccagaacgccgacgccuacgucuucgugggcaccucgcgguacuccaagaaguucaagcccgagaucgcgauccgcccgaaggugcgggaccaggagggccgcaugaacuacuacuggacccuggucgagcccggggacaagaucaccuucgaggccacgggcaaccucguggugccccgguacgccuucgccauggagcgcaacgccgggagcggcaucaucaucuccgacacccccguccacgacugcaacacgaccugccagaccccgaagggcgcgaucaacaccucgcugcccuuccagaacauccaccccaucaccaucgggaagugccccaaguacgugaaguccaccaagcugcggcucgccacgggccugcgcaacgugccgagcauccagucccgggggcuguucggcgccaucgccggguucaucgagggcggcuggaccgggauggucgacggcugguacggguaccaccaccagaacgagcagggcucgggguacgccgcggaccucaaguccacccagaacgccaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagucgacccgcaucuaccagauccuggccaucuacuccaccguggccucgucccugguccucguggugagccugggggccaucucguucuggaugugcuccaacggcagccugcagugccggaucugcaucuga

SEQ ID NO: 7125 - RNA, 1701 nt, Artificial Sequence; identical to SEQ ID NO: 7115
  derived and/or modified CDS sequence (AUadapt) from InfluenzaA__AEI86874__HA

SEQ ID NO: 7126 - RNA, 1701 nt, Artificial Sequence
  derived and/or modified CDS sequence (AUadapt) from InfluenzaA__AEI86894__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugagcuccuucgagcgcuucgagaucuuccccaagaccucguccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 7127 - RNA, 1701 nt, Artificial Sequence
  derived and/or modified CDS sequence (AUadapt) from InfluenzaA__AEI86904__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 7128 - RNA, 1701 nt, Artificial Sequence
  derived and/or modified CDS sequence (AUadapt) from InfluenzaA__AEI86914__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuacccccggcuguccaagucguacaucaacgacaagggcaaggaggugcugguccucugggggauccaccaccccagcaccacggccgaccagcagucccuguaccagaacgccgacgccuacguguucgugggcaccucgcgcuacuccaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcgccucgcgacgggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgucccuggugcucguggucagccugggggccaucucguucuggaugugcuccaacggcagccugcagugccgcaucugcaucuga

SEQ ID NO: 7129 - RNA, 1701 nt, Artificial Sequence
  derived and/or modified CDS sequence (AUadapt) from InfluenzaA__AEI86924__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcguguucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucaucaagaaggggaacucguaccccaagcuguccaagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccguccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgucccuggugcucgucgugagccugggggccaucucguucuggaugugcuccaacggcagccugcagugccggaucugcaucuga

SEQ ID NO: 7130 - RNA, 1701 nt, Artificial Sequence; identical to SEQ ID NO: 7115
  derived and/or modified CDS sequence (AUadapt) from InfluenzaA__AEI86934__HA

SEQ ID NO: 7131 - RNA, 1701 nt, Artificial Sequence; identical to SEQ ID NO: 88
  derived and/or modified CDS sequence (AUadapt) from InfluenzaA__AEI86944__HA

SEQ ID NO: 7132 - RNA, 1701 nt, Artificial Sequence
  derived and/or modified CDS sequence (AUadapt) from InfluenzaA__AEI86964__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcguguucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccacggccgaccagcagucccuguaccagaacgccgacgccuacguguucgucggcaccucgcgguacuccaagaaguucaagcccgagaucgccgugcgcccgaaggugcgggaccaggagggccgcaugaacuacuacuggacccuggucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccgaagggcgccaucaacaccucgcugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcucgggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacaugugcauggagucggucaagaacgggacguacgacuaccccaaguacuccgaggaggccaagcugaaccgggaggagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 7133 - RNA, 1701 nt, Artificial Sequence; identical to SEQ ID NO: 6071
  derived and/or modified CDS sequence (AUadapt) from InfluenzaA__AEI86974__HA

SEQ ID NO: 7134 - RNA, 1701 nt, Artificial Sequence; identical to SEQ ID NO: 88
  derived and/or modified CDS sequence (AUadapt) from InfluenzaA__AEI86984__HA

SEQ ID NO: 7135 - RNA, 1701 nt, Artificial Sequence; identical to SEQ ID NO: 88
  derived and/or modified CDS sequence (AUadapt) from InfluenzaA__AEI86994__HA

SEQ ID NO: 7136 - RNA, 1701 nt, Artificial Sequence
  derived and/or modified CDS sequence (AUadapt) from InfluenzaA__AEI87004__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgcgagcagcugucguccgugucguccuucgagcgguucgagaucuuccccaagaccagcuccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagggccuguaccagaacgccgacgccuacguguucgugggcacgucgcgcuacuccaagaaguucaagcccgagaucgccauccggccgaagguccgcgaccaggaggggcggaugaacuacuacuggacccugguggagcccggcgacaagaucaccuucgaggcgaccgggaaccucguggcgccccgcuacgccuucgccauggagcggaacgccggcucgggcaucaucaucuccgacacgcccguccacgacugcaacacgaccugccagaccccgaagggggccaucaacaccagccugcccuuccagaacauccaccccaucaccaucggcaagugccccaaguacgugaaguccaccaagcugcgccucgccaccgggcugcggaacgugccgucgauccagucccgcggccuguucggggccaucgccggcuucaucgagggcggguggacgggcauggucgacgggugguacggcuaccaccaccagaacgagcaggggagcggcuacgccgcggaccucaaguccacccagaacgccaucgacaagaucaccaacaaggugaacucggugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacuccaacgugaagaaccucuacgagaaggugcggucgcagcugaagaacaacgccaaggagaucggcaacgggugcuucgaguucuaccacaagugcgacaacacgugcauggaguccgucaagaacggcaccuacgacuaccccaaguacagcgaggaggcgaagcugaaccgcgaggagaucgacggggugaagcucgaguccacccggaucuaccagauccuggccaucuacucgaccguggccuccagccugguccucguggugucgcugggcgccaucuccuucuggaugugcagcaacggcucccugcagugccgcaucugcaucuga

SEQ ID NO: 7137 - RNA, 1701 nt, Artificial Sequence
  derived and/or modified CDS sequence (AUadapt) from InfluenzaA__AEI87014__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccggcgaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 7138 - RNA, 1701 nt, Artificial Sequence
  derived and/or modified CDS sequence (AUadapt) from InfluenzaA__AEI87034__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccaucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7139 - RNA, 1701 nt, Artificial Sequence; identical to SEQ ID NO: 88
  derived and/or modified CDS sequence (AUadapt) from InfluenzaA__AEI87044__HA

SEQ ID NO: 7140 - RNA, 1701 nt, Artificial Sequence; identical to SEQ ID NO: 4078
  derived and/or modified CDS sequence (AUadapt) from InfluenzaA__AEI87054__HA

SEQ ID NO: 7141 - RNA, 1701 nt, Artificial Sequence
  derived and/or modified CDS sequence (AUadapt) from InfluenzaA__AEI87064__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgcggccucgucccugguccucguggugagccugggggccaucucguucuggaugugcuccaacggcagccugcagugccggaucugcaucuga

SEQ ID NO: 7142 - RNA, 1701 nt, Artificial Sequence
  derived and/or modified CDS sequence (AUadapt) from InfluenzaA__AEI87074__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgacgaccgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucacgaacaaggugaacucggucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 7143 - RNA, 1701 nt, Artificial Sequence
  derived and/or modified CDS sequence (AUadapt) from InfluenzaA__AEI87094__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacacgggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcaucaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 7144 - RNA, 1701 nt, Artificial Sequence; identical to SEQ ID NO: 7143
  derived and/or modified CDS sequence (AUadapt) from InfluenzaA__AEI87104__HA

SEQ ID NO: 7145 - RNA, 1698 nt, Artificial Sequence; identical to SEQ ID NO: 3871
  derived and/or modified CDS sequence (AUadapt) from InfluenzaA__AEI91963__HA

SEQ ID NO: 7146 - RNA, 1701 nt, Artificial Sequence; identical to SEQ ID NO: 4078
  derived and/or modified CDS sequence (AUadapt) from InfluenzaA__AEI91977__HA

SEQ ID NO: 7147 - RNA, 1701 nt, Artificial Sequence; identical to SEQ ID NO: 5602
  derived and/or modified CDS sequence (AUadapt) from InfluenzaA__AEI91978__HA

SEQ ID NO: 7148 - RNA, 1701 nt, Artificial Sequence; identical to SEQ ID NO: 4544
  derived and/or modified CDS sequence (AUadapt) from InfluenzaA__AEI91998__HA

SEQ ID NO: 7149 - RNA, 1701 nt, Artificial Sequence
  derived and/or modified CDS sequence (AUadapt) from InfluenzaA__AEI91999__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccugaacgacaagcccuuccagaacgugaaccgcaucacguacggggcgugcccgcgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacaccaucgaccugacggacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 7150 - RNA, 1698 nt, Artificial Sequence
  derived and/or modified CDS sequence (AUadapt) from InfluenzaA__AEI92018__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucgccgaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacucgaccguggccagcucccuggugcuccuggucagccugggcgccaucuccuucuggaugugcagcaacgggucccuccagugccggaucugcaucuga

SEQ ID NO: 7151 - RNA, 1701 nt, Artificial Sequence; identical to SEQ ID NO: 7126
  derived and/or modified CDS sequence (AUadapt) from InfluenzaA__AEJ10400__HA

SEQ ID NO: 7152 - RNA, 1701 nt, Artificial Sequence
  derived and/or modified CDS sequence (AUadapt) from InfluenzaA__AEJ10410__HA
augaagaccauccuggugguccuccuguacaccuucgccacggccaacgcggacacccugugcaucggcuaccacgccaacaacucgaccgacaccaucgacacggugcucgagaagaacgugaccgucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagacguccagcuccgacaacgggaccugcuaccccggcaacuucaucgacuacgaggagcuccgggagcagcugucguccgugagcuccuucgagcgcuucgagaucuuccccaagaccucguccuggagcgaccacgacuccaacaagggcgugaccgccgccugcccccacgccggcgccaagucguucuacaagaaccugaucuggcucgucaagaaggggaacuccuacccgaagcugagcaagucguacaucaacgacaagggcaaggaggugcuggugcucugggggauccaccaccccuccacgagcgcggaccagcagucccuguaccagaacgccgacgccuacgucuucgugggcaccucgcgguacuccaagaaguucaagcccgagaucgccauccgccccaaggugcgggaccaggagggccgcaugaacuacuacuggacccuggucgagccgggggacaagaucaccuucgaggccacgggcaaccucguggcgccccgguacgccuucgccauggagcgcaacgccgggagcggcaucaucaucuccgacacccccgugcacgacugcaacacgaccugccagacccccaagggcgccaucaacaccucgcugccguuccagaacauccaccccaucaccaucgggaagugccccaaguacgucaaguccaccaagcugcggcucgcgacgggccugcgcaacgugcccagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggucaacagcgugaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgucaagcucgaguccacccgcaucuaccagauccuggcgaucuacucgaccguggccagcucccuggugcucgucgugucgcugggggccaucuccuucuggaugugcagcaacggcucccugcagugccggaucugcaucuga

SEQ ID NO: 7153 - RNA, 1701 nt, Artificial Sequence
  derived and/or modified CDS sequence (AUadapt) from InfluenzaA__AEJ10420__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggaccgccacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7154 - RNA, 1701 nt, Artificial Sequence
  derived and/or modified CDS sequence (AUadapt) from InfluenzaA__AEJ10430__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccacccgcccacgucggcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 7155 - RNA, 1701 nt, Artificial Sequence
  derived and/or modified CDS sequence (AUadapt) from InfluenzaA__AEJ10440__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagauccuguaccagaacgccgacaccuacguguucgugggcaccucccgguacucgaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 7156 - RNA, 1701 nt, Artificial Sequence; identical to SEQ ID NO: 7069
  derived and/or modified CDS sequence (AUadapt) from InfluenzaA__AEJ10450__HA

SEQ ID NO: 7157 - RNA, 1701 nt, Artificial Sequence
  derived and/or modified CDS sequence (AUadapt) from InfluenzaA__AEJ10480__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcaggccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccaguccgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgucgauccagucccgcggccucuucggggccaucgccggguucaucgagggcggcuggacggggaugguggacggcugguacggguaccaccaccagaacgcccagggcagcggguacgccgcggaccugaaguccacccagaacgccaucgacaagaucaccaacaaggugaacucggucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggcgaagcucaaccgcgaggagaucgacggcgugaagcuggaguccacccggaucuaccagauccuggccaucuacagcaccgucgccucgucccucgugcugguggucagccugggggccaucuccuucuggaugugcagcaacggcucccuccagugccgcaucugcaucuga

SEQ ID NO: 7158 - RNA, 1701 nt, Artificial Sequence
  derived and/or modified CDS sequence (AUadapt) from InfluenzaA__AEJ10490__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccaccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccacccgcccacgagcgcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggcggugcccgaaguacgugaaguccaccaagcugcgccucgccacgggccugcggaacguccccagcauccagucccgcgggcuguucggcgcgaucgccggguucaucgagggcggcuggaccgggaugguggacggcugguacggguaccaccaccagaacgagcagggcucgggguacgccgccgaccucaaguccacccagaacgccaucgacggcaucaccaacaaggugaacagcgucaucgagaagaugaacacgcaguucaccgcggugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccaccaugaucuaccagauccuggccaucuacucgaccgucgcguccagccuggugcucaucgugucgcugggcgccaucuccuucuggaugugcagcaacggcucccugcagugccggaucugcaucuga

SEQ ID NO: 7159 - RNA, 1701 nt, Artificial Sequence
  derived and/or modified CDS sequence (AUadapt) from InfluenzaA__AEJ10500__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagucgcuguccaccgccagcuccuggucguacaucguggagaccuccucguccgacaacggcacgugcuaccccggggacuucaucgacuacgaggagcuccgggagcagcugagcuccgugucguccuucgagcgcuucgagaucuuccccaagaccucguccuggcccaaccacgacagcaacaagggcgucaccgccgccugcccgcacgccggggcgaagggcuucuacaagaaccugaucuggcucgugaagaaggggaacuccuaccccaagcugaacaagucguacaucaacgacaagggcaaggaggugcugguccucuggggcauccaccaccccuccaccacggccgaccagcagucgcuguaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggcucggggaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggcuucaucgagggcggguggaccgggaugguggacggcugguacggguaccaccaccagaacgagcagggcucgggcuacgccgccgaccucaaguccacccagaacgccaucgacaagaucacgaacaaggugaacucggucaucgagaagaugaacacccaguucaccgcgguggggaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgucgucccuggugcucguggucagccugggcgccaucuccuucuggaugugcucgaacgggagccugcagugccggaucugcaucuga

SEQ ID NO: 7160 - RNA, 1701 nt, Artificial Sequence; identical to SEQ ID NO: 7112
  derived and/or modified CDS sequence (AUadapt) from InfluenzaA__AEJ10510__HA

SEQ ID NO: 7161 - RNA, 1701 nt, Artificial Sequence
  derived and/or modified CDS sequence (AUadapt) from InfluenzaA__AEJ10520__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaacuacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugcucgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 7162 - RNA, 1701 nt, Artificial Sequence; identical to SEQ ID NO: 116
  derived and/or modified CDS sequence (AUadapt) from InfluenzaA__AEJ10530__HA

SEQ ID NO: 7163 - RNA, 1701 nt, Artificial Sequence; identical to SEQ ID NO: 116
  derived and/or modified CDS sequence (AUadapt) from InfluenzaA__AEJ10540__HA

SEQ ID NO: 7164 - RNA, 1701 nt, Artificial Sequence; identical to SEQ ID NO: 116
  derived and/or modified CDS sequence (AUadapt) from InfluenzaA__AEJ10550__HA

SEQ ID NO: 7165 - RNA, 1701 nt, Artificial Sequence
  derived and/or modified CDS sequence (AUadapt) from InfluenzaA__AEJ10570__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacgacgggaagcugugcaagcugcgcggcgucgcgccccuccaccuggggaagugcaacaucgccggcuggauccuggggaacccggagugcgagucgcucuccaccgccagcuccuggucguacaucguggagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucucggacacgcccgugcacgacugcaacgcgaccugccagaccccgaagggcgccaucaacaccucccugcccuuccagaacauccaccccaucacgaucgggaagugccccaaguacgucaagagcaccaagcuccggcuggccaccggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagucgacgcagaacgccaucgacaagaucaccaacaaggugaacuccgucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgggaggagaucgacggcgugaagcuggagagcacccgcaucuaccagauccuggccaucuacuccaccgucgccucgagccucgugcugguggucucccugggggccaucucguucuggaugugcuccaacggcagccuccagugccggaucugcaucuga

SEQ ID NO: 7166 - RNA, 1701 nt, Artificial Sequence; identical to SEQ ID NO: 7165
  derived and/or modified CDS sequence (AUadapt) from InfluenzaA__AEJ10580__HA

SEQ ID NO: 7167 - RNA, 1701 nt, Artificial Sequence
  derived and/or modified CDS sequence (AUadapt) from InfluenzaA__AEJ36302__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccuacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugucgaaguccuacaucaacgacaagggcaaggaggugcugguccucugggggauccaccaccccagcaccucggccgaccagcagcggcuguaccagaacgccgacgccuacgccuucgugggcacgucccgcuacucgaagaaguucaagccggagaucgcgauccggcccaaggugcgcgaccaggagggccggaugaacuacuacuggacccuggucgagcccggggacaagaucaccuucgaggccaccggcaaccucguggugccccgcuacgccuucgccauggagcggaacgccggguccggcaucaucaucagcgacacgccggcgcacgacugcaacacgaccugccagacccccaagggcgccaucaacaccucccugcccuuccagaacguccaccccaucaccaucgggaagugcccgaaguacgucaagucgaccaagcugcgccucgccaccggccugcggaacgugcccuccauccagagccgcgggcuguucggcgccaucgccggguucaucgagggcggcuggacggggaugguggacggcugguacggguaccaccaccagaacgagcagggcuccggguacgcggccgaccucaagucgacccagaacgccuucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacucgaacgugaagaaccucuacgagaaggugcggucccagcugaagaacaacgcgaaggagaccgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagucgacccggaucuaccagauccuggccaucuacuccaccguggccucgucccugguccucguggugagccugggggcgaucucguucuggaugugcuccaacggcagccugcagugccgcaucugcaucuga

SEQ ID NO: 7168 - RNA, 1701 nt, Artificial Sequence
  derived and/or modified CDS sequence (AUadapt) from InfluenzaA__AEJ36312__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacauccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 7169 - RNA, 1701 nt, Artificial Sequence
  derived and/or modified CDS sequence (AUadapt) from InfluenzaA__AEJ37853__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggaggccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgcgggcgccaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucucggacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacaugugcauggagagcgugaagaacgggaccuacgacuaccccaaguacuccgaggaggcgaagcugaaccgggaggagaucgacggcgugaagcucgagucgacccgcaucuaccagauccuggccaucuacuccacggucgccagcucgcuggugcucguggucucccugggggccaucagcuucuggaugugcuccaacggcagccugcagugccggaucugcaucuga

SEQ ID NO: 7170 - RNA, 1701 nt, Artificial Sequence
  derived and/or modified CDS sequence (AUadapt) from InfluenzaA__AEJ37863__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagcugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 7171 - RNA, 1701 nt, Artificial Sequence; identical to SEQ ID NO: 4078
  derived and/or modified CDS sequence (AUadapt) from InfluenzaA__AEJ37873__HA

SEQ ID NO: 7172 - RNA, 1701 nt, Artificial Sequence; identical to SEQ ID NO: 7126
  derived and/or modified CDS sequence (AUadapt) from InfluenzaA__AEJ37883__HA

SEQ ID NO: 7173 - RNA, 1701 nt, Artificial Sequence
  derived and/or modified CDS sequence (AUadapt) from InfluenzaA__AEJ37893__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcaacuucaucgacuacgaggagcuccgggagcagcugucguccgugagcuccuucgagcgcuucgagaucuuccccaagaccucguccuggcccgaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggcgccccgguacgccuucgccauggagcgcaacgccggguccggcaucaucaucucggacaagcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7174 - RNA, 1701 nt, Artificial Sequence; identical to SEQ ID NO: 7126
  derived and/or modified CDS sequence (AUadapt) from InfluenzaA__AEJ37903__HA

SEQ ID NO: 7175 - RNA, 1701 nt, Artificial Sequence
  derived and/or modified CDS sequence (AUadapt) from InfluenzaA__AEJ37923__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccaucgagcgcauggccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 7176 - RNA, 1701 nt, Artificial Sequence
  derived and/or modified CDS sequence (AUadapt) from InfluenzaA__AEJ37943__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7177 - RNA, 1701 nt, Artificial Sequence; identical to SEQ ID NO: 7126
  derived and/or modified CDS sequence (AUadapt) from InfluenzaA__AEJ37953__HA

SEQ ID NO: 7178 - RNA, 1701 nt, Artificial Sequence
  derived and/or modified CDS sequence (AUadapt) from InfluenzaA__AEJ37963__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugucguccuucgagcgcuucgagaucuuccccaagaccagcuccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucagcgacacgcccguccacgacugcaacacgaccugccagaccccgaagggcgccaccaacaccucccugcccuuccagaacauccaccccaucaccaucgggaagugccccaaguacgucaagucgaccaagcugcggcucgccacgggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagagcacccagaacgccaucgacaagaucaccaacaaggugaacuccgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagucgacccgcaucuaccagauccuggccaucuacuccaccguggccucgagccugguccucguggugucccugggggccaucucguucuggaugugcuccaacggcagccugcagugccggaucugcaucuga

SEQ ID NO: 7179 - RNA, 1701 nt, Artificial Sequence; identical to SEQ ID NO: 4078
  derived and/or modified CDS sequence (AUadapt) from InfluenzaA__AEJ37973__HA

SEQ ID NO: 7180 - RNA, 1701 nt, Artificial Sequence; identical to SEQ ID NO: 7126
  derived and/or modified CDS sequence (AUadapt) from InfluenzaA__AEJ37983__HA

SEQ ID NO: 7181 - RNA, 1701 nt, Artificial Sequence; identical to SEQ ID NO: 5778
  derived and/or modified CDS sequence (AUadapt) from InfluenzaA__AEK21369__HA

SEQ ID NO: 7182 - RNA, 1698 nt, Artificial Sequence; identical to SEQ ID NO: 3861
  derived and/or modified CDS sequence (AUadapt) from InfluenzaA__AEK21380__HA

SEQ ID NO: 7183 - RNA, 1701 nt, Artificial Sequence
  derived and/or modified CDS sequence (AUadapt) from InfluenzaA__AEK21396__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccuccuggugccccgcuacgccuucgagauggagcggaaguccgggucgggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcuccgccuggccaccggccugcggaacgugccgucgauccagucccgcggccucuucggggccaucgcgggguucaucgagggcggcuggacggggauggucgacggcugguacggguaccaccaccagaacgagcagggcagcggguacgccgccgaccugaaguccacccagaacgccaucgacgagaucaccaacaaggugaacucggugaucgagaagaugaacacccaguucacggccgucggcaaggaguucaaccaccuggagaagcggaucgagaaccucaacaagaagguggacgacggcuuccuggacaucuggaccuacaacgcggagcugcucguccugcuggagaacgagcgcacccucgacuaccacgacuccaacgugaagaaccuguacgagaaggugcggagccagcugaagaacaacgccaaggagaucgggaacggcugcuucgaguucuaccacaagugcgacaacacgugcauggaguccgucaagaacgggaccuacgacuaccccaaguacucggaggaggccaagcucaaccgcgagaagaucgacggcgugaagcuggaguccacccggaucuaccagauccuggccaucuacagcaccguggccucgucccucguccugguggugagccugggggcgaucuccuucuggaugugcagcaacggcucccuccagugccgcaucugcaucuga

SEQ ID NO: 7184 - RNA, 1701 nt, Artificial Sequence
  derived and/or modified CDS sequence (AUadapt) from InfluenzaA__AEK21406__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccaugagcuccuucgagcgcuucgagaucuuccccaagaccucguccuggcccgaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7185 - RNA, 1701 nt, Artificial Sequence
  derived and/or modified CDS sequence (AUadapt) from InfluenzaA__AEK21416__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcguguucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccacggccgaccagcagucccuguaccagaacgccgacgccuacguguucgucggcaccucgcgguacuccaagaaguucaagcccgagaucgccgugcgcccgaaggugcgggaccaggagggccgcaugaacuacuacuggacccuggucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccgaagggcgccaucaacaccucgcugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcucgggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 7186 - RNA, 1701 nt, Artificial Sequence
  derived and/or modified CDS sequence (AUadapt) from InfluenzaA__AEK21426__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugagcuccuucgagcgcuucgagaucuuccccaagaccucguccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgugcggagcaccaagcugcgccucgccaccggccugcggaacgugccguccauccagucgcgcgggcuguucggcgccaucgccggguucaucgagggcggcuggacggggauggucgacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgcgaggagaucgacggcgugaagcucgagagcacccggaucuaccagauccuggccaucuacuccaccguggccucgagccugguccucguggugucccugggggccaucucguucuggaugugcuccaacggcagccugcagugccgcaucugcaucuga

SEQ ID NO: 7187 - RNA, 1701 nt, Artificial Sequence; identical to SEQ ID NO: 4078
  derived and/or modified CDS sequence (AUadapt) from InfluenzaA__AEK21436__HA

SEQ ID NO: 7188 - RNA, 1701 nt, Artificial Sequence
  derived and/or modified CDS sequence (AUadapt) from InfluenzaA__AEK21456__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagaacgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7189 - RNA, 1701 nt, Artificial Sequence; identical to SEQ ID NO: 7126
  derived and/or modified CDS sequence (AUadapt) from InfluenzaA__AEK21466__HA

SEQ ID NO: 7190 - RNA, 1701 nt, Artificial Sequence; identical to SEQ ID NO: 7126
  derived and/or modified CDS sequence (AUadapt) from InfluenzaA__AEK21476__HA

SEQ ID NO: 7191 - RNA, 1701 nt, Artificial Sequence; identical to SEQ ID NO: 4078
  derived and/or modified CDS sequence (AUadapt) from InfluenzaA__AEK21486__HA

SEQ ID NO: 7192 - RNA, 1701 nt, Artificial Sequence
  derived and/or modified CDS sequence (AUadapt) from InfluenzaA__AEK28774__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgauccaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 7193 - RNA, 1701 nt, Artificial Sequence
  derived and/or modified CDS sequence (AUadapt) from InfluenzaA__AEK28785__HA
augaagaccaucaucgcccugucguacauccucugccugguguucgcccagaaccugcccggcaacgacaacuccgcggccacccucugccuggggcaccacgccgucccgaacggcacgaucgugaagaccaucaccaacgaccagguggaggucaccaacgccacggagcuggugcagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggcguacucgaacugcuaccccuacgacgucccggacuacgccucccugcggagccucguggccuccucgggcacccuggaguucaacaacgaguccuucaacuggacgggggugacccagaacggcaccucguccgccugcauccgccggagcaacaacuccuucuucucgcgccugaacuggcucacccaccugaacuucaaguaccccgcgcugaacgucacgaugcccaacaacgagcaguucgacaagcucuacaucuggggcgugcaccaccccgggaccgacaaggaccagaucuuccuguacgcccaggccuccgggcggaucaccgugagcaccaagcgcucccagcaggccgucaucccgaacaucggcucgcggccccgcgugcggaacauccccucgcgcaucuccaucuacuggacgaucgugaagcccggcgacauccugcucaucaacagcaccgggaaccugaucgccccgcggggcuacuucaagauccgcuccggcaagucguccaucaugcggagcgacgcgcccaucgggaagugcaacuccgagugcaucacccccaacggcucgauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagucgacccaggccgccaucgaccagaucaacgggaagcugaaccgccugaucggcaagacgaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccauccaccucaccgacuccgagaugaacaagcuguucgagaagacgaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 7194 - RNA, 1701 nt, Artificial Sequence
  derived and/or modified CDS sequence (AUadapt) from InfluenzaA__AEK28796__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgacaagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccaggacggcaccuccucggccugcauccgcggguccaagaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgccaucccgaacaucggcucgcgcccccgggugcgcaacauccccucccggaucagcaucuacuggaccaucgucaagcccggggacauccugcucaucaacuccaccggcaaccugaucgccccgcgcggguacuucaagauccggucgggcaaguccagcaucaugcgcuccgacgcgcccaucggcaagugcaacucggagugcaucacccccaacggguccauccccaacgacaagccguuccagaacgugaaccggaucacguacggcgccugcccccgcuacgugaagcagaacacccugaagcucgccaccgggaugcggaacguccccgagaagcagacccgcggcaucuucggggccaucgccggcuucaucgagaacggcugggaggggaugguggacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcgcuggagaaccagcacaccauccaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcgcugcucggguucaucaugugggccugccagaagggcaacauccgcugcaacaucugcaucuga

SEQ ID NO: 7195 - RNA, 1701 nt, Artificial Sequence
  derived and/or modified CDS sequence (AUadapt) from InfluenzaA__AEK28807__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacggcaacugcuaccccuacgacgugccggacuacgcgucccugcggucgcucgucgccuccucggggacgcuggaguucaacaacgaguccuucaacuggaccggcgugacccagaacgggaccagcuccgccugcauccgcaagucgaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccggccgcaucaccgugucgacgaagcggucccagcagaccgugaucccgaacaucggcucgcgcccccggguccgcaacauccccagccggaucuccaucuacuggaccaucgugaagcccggggacauccugcucaucaacucgaccggcaaccugaucgccccgcgcggguacuucaagauccgguccggcaagagcuccaucaugcgcucggacgcccccaucggcaagugcaacuccgagugcaucacgcccaacgggucgauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggccgcgggcaggccgccgaccugaaguccacccaggcggccaucgaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgauccaccucaccgacuccgagaugaacaagcuguucgagaagaccaagaagcagcugcgggagaacgccgaggacaugggcaacgggugcuucaagaucuaccacaagugcgacaacgcgugcaucggcucgauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 7196 - RNA, 1701 nt, Artificial Sequence
  derived and/or modified CDS sequence (AUadapt) from InfluenzaA__AEK28818__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacaacgagagcuucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcucgcagcagaccgugaucccgaacaucggcagccggccccgcguccggaacauccccucccgcaucucgaucuacuggaccaucgugaagcccggcgacauccugcucaucaacaacaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgauccaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 7197 - RNA, 1701 nt, Artificial Sequence
  derived and/or modified CDS sequence (AUadapt) from InfluenzaA__AEK28828__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgugaucccgaacaucggcagccggccccgcguccgggacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgauccaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggucugccagaaggggaacauccggugcaacaucugcaucuga

SEQ ID NO: 7198 - RNA, 1701 nt, Artificial Sequence; identical to SEQ ID NO: 2679
  derived and/or modified CDS sequence (AUadapt) from InfluenzaA__AEK28839__HA

SEQ ID NO: 7199 - RNA, 1701 nt, Artificial Sequence
  derived and/or modified CDS sequence (AUadapt) from InfluenzaA__AEK28850__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggcugcgcguccggaacauccccucccgcaucucgaucuacuggaccaucgugaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacucggagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 7200 - RNA, 1701 nt, Artificial Sequence
  derived and/or modified CDS sequence (AUadapt) from InfluenzaA__AEK28861__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugaaggagaacgccgaggacauggggaacggcugcuucaagaucuaccacaagugcgacaacgcgugcaucggguccauccgcaacggcaccuacgaccacgacgucuaccgcgacgaggcccucaacaaccgguuccacaucaaggggguggagcugaaguccggcuacaaggacuggauccuguggaucuccuucgccacgagcugcuuccuccugugcguggcccugcucggcuucaucaugugggccugccagaaggggaacauccgcugcaacaucugcaucuga

SEQ ID NO: 7201 - RNA, 1701 nt, Artificial Sequence
  derived and/or modified CDS sequence (AUadapt) from InfluenzaA__AEK28872__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccgggacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgauccaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 7202 - RNA, 1701 nt, Artificial Sequence
  derived and/or modified CDS sequence (AUadapt) from InfluenzaA__AEK28883__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccagcgccugcauccgccgguccucgaacuccuucuucagccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccuccgggcggaucaccgucucgacgaagcgcagccagcagaccgugaucccgaacaucggcucccggccccgcgugcggaacauccccucgcgcaucuccaucuacuggaccaucgucaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgauccaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 7203 - RNA, 1701 nt, Artificial Sequence
  derived and/or modified CDS sequence (AUadapt) from InfluenzaA__AEK28894__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgauccaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 7204 - RNA, 1701 nt, Artificial Sequence
  derived and/or modified CDS sequence (AUadapt) from InfluenzaA__AEK28905__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccuccgguucaaguaccccgcccugaacgugaccaugcccaacaacgagcaguucgacaagcucuacaucuggggcguccaccaccccgggaccgacaacgaccagaucuucccguacgcgcaggccucggggcgcaucaccguguccacgaagcggagccagcagaccgugauccccaacaucggcucgcgcccccggguccgcaacauccccucccggaucucgaucuacuggaccaucgugaagccgggcgacauccugcugaucaacuccaccgggaaccucaucgcgccccgcggcuacuucaagauccggagcgggaaguccucgaucaugcgcuccgacgcccccaucggcaagugcaacagcgagugcaucacgcccaacggcuccaucccgaacgacaagcccuuccagaacgugaaccggaucaccuacggggccugcccccgcuacgucaagcagaacacccugaagcuggccaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccucaaguccacccaggcggccaucgaccagaucaacgggaagcugaaccggcugaucggcaagaccaacgagaaguuccaccagaucgagaaggaguucucggaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 7205 - RNA, 1701 nt, Artificial Sequence
  derived and/or modified CDS sequence (AUadapt) from InfluenzaA__AEK28916__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcauccggaacauccccucccgcaucagcaucuacuggaccaucgucaagcccggcgacauccugcucaucaacuccaccgggaaccugaucgccccgcggggcuacuucaagauccgcucggggaaguccucggugaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 7206 - RNA, 1701 nt, Artificial Sequence
  derived and/or modified CDS sequence (AUadapt) from InfluenzaA__AEK28927__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccucggggcggaucaccgucuccacgaagcgcagccagcagaccgugaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgauccaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 7207 - RNA, 1701 nt, Artificial Sequence
  derived and/or modified CDS sequence (AUadapt) from InfluenzaA__AEK28949__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugccucaagaucuaccacaagugcgacaacgcgugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 7208 - RNA, 1701 nt, Artificial Sequence; identical to SEQ ID NO: 2679
  derived and/or modified CDS sequence (AUadapt) from InfluenzaA__AEK28960__HA

SEQ ID NO: 7209 - RNA, 1701 nt, Artificial Sequence; identical to SEQ ID NO: 2679
  derived and/or modified CDS sequence (AUadapt) from InfluenzaA__AEK28971__HA

SEQ ID NO: 7210 - RNA, 1701 nt, Artificial Sequence
  derived and/or modified CDS sequence (AUadapt) from InfluenzaA__AEK28982__HA
augaagaccaucaucgcccugucguacauccucugccugguguucgcccagaagcugcccggcaacuacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgauccaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 7211 - RNA, 1701 nt, Artificial Sequence
  derived and/or modified CDS sequence (AUadapt) from InfluenzaA__AEK28993__HA
augaagaccaucaucgcccugucguacauccucugccugguguucgcccagaagcugcccggcaacuacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 7212 - RNA, 1701 nt, Artificial Sequence
  derived and/or modified CDS sequence (AUadapt) from InfluenzaA__AEK29004__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgucucgcugcggucccucguggcgagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcccaggcgucggggcggaucaccguguccacgaagcgcagccagcaggccgucaucccgaacaucggcucgcggccccgcgugcggaacauccccucccgcgugagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgccugcaucacccccaacggcuccauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 7213 - RNA, 1701 nt, Artificial Sequence
  derived and/or modified CDS sequence (AUadapt) from InfluenzaA__AEK29026__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccaggacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguacagcgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcagccagcagaccgugauccccaacaucggcucccggccgcgcguccggaacauccccucgcgcaucuccaucuacuggaccaucgugaagcccggcgacauccugcucaucaacagcaccgggaaccugaucgcgccccggggcuacuucaagaugcaguccgggaaguccuccaucaugcgcucggacgccccgaucggcaagugcaacuccgagugcaucacgcccaacggcagcauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 7214 - RNA, 1701 nt, Artificial Sequence
  derived and/or modified CDS sequence (AUadapt) from InfluenzaA__AEK29048__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccgggguggcccagaacggcaccuccagcgccugcauccgccgguccaacaacucguucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccgccgggcggaucaccgugucgaccaagcgcucccagcaggccgugaucccgaacaucggcagccggccccgcguccggaacauccccucgcgcguguccaucuacuggacgaucgugaagcccggcgacauccugcucaucaacucgaccgggaaccugaucgcgccgcggggcuacuucaagauccgcuccgggaaguccuccaucaugcggagcgacgcccccaucggcaagugcaacuccgccugcaucacccccaacggcucgauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgcgaucgccggguucaucgagaacggcugggagggcauggucgacgggugguacggcuuccgccaccagaacuccgaggggcggggccaggccgccgaccucaagucgacccaggccgcgaucgaccagaucaacgggaagcugaaccgccugaucggcaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccgcaacggcaccuacgaccacgacguguaccgggacgaggcgcucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 7215 - RNA, 1701 nt, Artificial Sequence
  derived and/or modified CDS sequence (AUadapt) from InfluenzaA__AEK29070__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccauccaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 7216 - RNA, 1701 nt, Artificial Sequence
  derived and/or modified CDS sequence (AUadapt) from InfluenzaA__AEK29081__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcuccugcauccgccggucgaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccaggcguccgggcggaucaccgugucgacgaagcgcagccagcaggccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacccccaacggcagcauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccauccaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 7217 - RNA, 1701 nt, Artificial Sequence; identical to SEQ ID NO: 5778
  derived and/or modified CDS sequence (AUadapt) from InfluenzaA__AEK29092__HA

SEQ ID NO: 7218 - RNA, 1701 nt, Artificial Sequence; identical to SEQ ID NO: 7100
  derived and/or modified CDS sequence (AUadapt) from InfluenzaA__AEK29125__HA

SEQ ID NO: 7219 - RNA, 1701 nt, Artificial Sequence; identical to SEQ ID NO: 7100
  derived and/or modified CDS sequence (AUadapt) from InfluenzaA__AEK29136__HA

SEQ ID NO: 7220 - RNA, 1701 nt, Artificial Sequence; identical to SEQ ID NO: 7100
  derived and/or modified CDS sequence (AUadapt) from InfluenzaA__AEK29169__HA

SEQ ID NO: 7221 - RNA, 1701 nt, Artificial Sequence; identical to SEQ ID NO: 7100
  derived and/or modified CDS sequence (AUadapt) from InfluenzaA__AEK29180__HA

SEQ ID NO: 7222 - RNA, 1701 nt, Artificial Sequence; identical to SEQ ID NO: 7100
  derived and/or modified CDS sequence (AUadapt) from InfluenzaA__AEK29191__HA

SEQ ID NO: 7223 - RNA, 1701 nt, Artificial Sequence; identical to SEQ ID NO: 7100
  derived and/or modified CDS sequence (AUadapt) from InfluenzaA__AEK29202__HA

SEQ ID NO: 7224 - RNA, 1701 nt, Artificial Sequence; identical to SEQ ID NO: 7100
  derived and/or modified CDS sequence (AUadapt) from InfluenzaA__AEK29213__HA

SEQ ID NO: 7225 - RNA, 1701 nt, Artificial Sequence; identical to SEQ ID NO: 7100
  derived and/or modified CDS sequence (AUadapt) from InfluenzaA__AEK29224__HA

SEQ ID NO: 7226 - RNA, 1701 nt, Artificial Sequence; identical to SEQ ID NO: 7100
  derived and/or modified CDS sequence (AUadapt) from InfluenzaA__AEK29235__HA

SEQ ID NO: 7227 - RNA, 1701 nt, Artificial Sequence
  derived and/or modified CDS sequence (AUadapt) from InfluenzaA__AEK29268__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 7228 - RNA, 1698 nt, Artificial Sequence
  derived and/or modified CDS sequence (AUadapt) from InfluenzaA__AEK59838__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccgaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagcaagaaguucacgcccgagaucgccaagcgccccaaggugcgggaccaggagggccgcaucaacuacuacuggacccuccuggagcccgggaacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 7229 - RNA, 1701 nt, Artificial Sequence
  derived and/or modified CDS sequence (AUadapt) from InfluenzaA__AEK98378__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcgcaggccagcgggcggaucaccguguccacgaagcgcucgcagcagaccgugauccccaacaucggcagccggccccgcguccggaacauccccucccgcaucucgaucuacuggaccaucgugaagccgggcgacauccugcugaucaacuccaccgggaaccucaucgcgccccggggcuacuucaagauccagagcgggaaguccucgaucaugcgcuccgacgcccccaucggcaagugcaacucggagugcaucacgcccaacggcuccaucccgaacgacaagcccuuccagaacgugaaccggaucaccuacggggccugcccccgcuacgucaagcagaacacccugaagcuggccaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccucaaguccacccaggcggccaucgaccagaucaacgggaagcugaaccgccugaucggcaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaaggggguggagcucaagucgggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 7230 - RNA, 1701 nt, Artificial Sequence; identical to SEQ ID NO: 2160
  derived and/or modified CDS sequence (AUadapt) from InfluenzaA__AEK98380__HA

SEQ ID NO: 7231 - RNA, 1701 nt, Artificial Sequence
  derived and/or modified CDS sequence (AUadapt) from InfluenzaA__AEK98382__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugucgacgaagcgcucccagcagaccgugaucccgaacaucggcucgcggccccgcauccggaacauccccagccgcaucuccaucuacuggaccaucgucaagcccggcgacauccugcucaucaacucgaccgggaaccugaucgccccgcggggcuacuucaagauccagaucgggaaguccagcaucaugcgcuccgacgcccccaucggcaagugcaacucggagugcaucacgcccaacggcuccauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgcuuccagaucaagggggucgagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 7232 - RNA, 1701 nt, Artificial Sequence
  derived and/or modified CDS sequence (AUadapt) from InfluenzaA__AEK98386__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggacccgcguccggaacauccccucccgcgugagcaucuacuggaccaucgugaagcccggcgacauccugcucaucaacuccaccgggaaccugaucgcgccccggggcuacuucaagauccgcucggggaaguccagcaucaugcgguccgacgccccgaucggcaagugcaacucggccugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 7233 - RNA, 1701 nt, Artificial Sequence
  derived and/or modified CDS sequence (AUadapt) from InfluenzaA__AEK98388__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggccugcagaacaagaagugggaccuguucguggagcgcucgaaggccuacuccaacugcuaccccuacgacgugccggacuacgcgagccuccggucccuggucgccucguccggcacgcuggaguucaacaacgagucguucaacuggaccggggugacccagaacggcaccuccagcgccugcauccgccgguccaagaacucguucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccuccugaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcucaaccgccugaucggcaagaccaacgagaaguuccaccagaucgagaaggaguucucggagguggagggccggauccaggaccuggagaaguacgucgaggacaccaagaucgaccucugguccuacaacgccgagcugcugguggcccucgagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 7234 - RNA, 1701 nt, Artificial Sequence
  derived and/or modified CDS sequence (AUadapt) from InfluenzaA__AEK98390__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaagucggcgugcaucacccccaacggcuccauccccaacgacaagacguuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 7235 - RNA, 1701 nt, Artificial Sequence
  derived and/or modified CDS sequence (AUadapt) from InfluenzaA__AEK98392__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccgacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccucguccggcacgcuggaguucaacaacgagaacuucaacuggaccggggugacccagaacggcaccagcuccgccugcauccgccggucgaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcucccagcaggccgugaucccgaacaucggcucgcggcugcgcguccggaacauccccagccgcguguccaucuacuggaccaucgugaagcccggcgacauccuccugaucaacucgaccgggaaccugaucgcgccccggggcuacuucaagauccgcuccgggaaguccuccaucaugcggagcgacgccccgaucggcaagugcaacuccgccugcaucacccccaacggcucgauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccucuggagcuacaacgccgagcugcuggucgcgcucgagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggucgauccgcaacggcaccuacgaccacgacguguaccgggacgaggcccugaacaaccgcuuccagaucaaggggguggagcugaaguccggcuacaaggacuggauccucuggaucagcuucgccaucuccugcuuccugcugugcgucgcgcuccugggcuucaucaugugggccugccagaaggggaacauccggugcaacaucugcaucuga

SEQ ID NO: 7236 - RNA, 1701 nt, Artificial Sequence
  derived and/or modified CDS sequence (AUadapt) from InfluenzaA__AEK98394__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggcugcgcguccggaacauccccucccgcgugagcaucuacuggaccaucgugaagcccggcgacauccuccugaucaacuccaccgggaaccugaucgcgccccggggcuacuucaagauccgcucggggaaguccucgaucaugcgguccgacgccccgaucggcaagugcaacagcgccugcaucacccccaacggcuccauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacaccaucgaccugacggacucggagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 7237 - RNA, 1701 nt, Artificial Sequence
  derived and/or modified CDS sequence (AUadapt) from InfluenzaA__AEK98396__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaagucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucagccuguacgcgcaggccuccgggcggaucaccgugucgacgaagcgcucgcagcagaccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcaucgcccugcucggcuucaucaugugggccugccagaaggggaacauccggugcaacaucugcaucuga

SEQ ID NO: 7238 - RNA, 1701 nt, Artificial Sequence
  derived and/or modified CDS sequence (AUadapt) from InfluenzaA__AEK98398__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggccugcagaacaagaagugggaccuguucguggagcgcucgaaggccuacuccaacugcuaccccuacgacgugccggacuacgcgagccuccggucccuggucgccucguccggcacgcuggaguucaacaacgagucguucaacuggaccggggugacccagaacggcaccuccagcgccugcauccgccgguccaagaacucguucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccuccugaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccucaagcuggccaccggcaugcgcaacauccccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcucaaccgccugaucggcaagaccaacgagaaguuccaccagaucgagaaggaguucucggagguggagggccggauccaggaccuggagaaguacguggaggacaccaagaucgaccucugguccuacaacgccgagcugcuggucgcccucgagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggaucaucuggaucuccuucgccaucagcugcuuccuccugugcgucgcccugcucggcuucaucaugugggcgugccagaaggggaacauccggugcaacaucugcaucuga

SEQ ID NO: 7239 - RNA, 1701 nt, Artificial Sequence
  derived and/or modified CDS sequence (AUadapt) from InfluenzaA__AEK98400__HA
auggagaccaucaucgcccugucguacauccucucccugguguucgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgagaacuucaacuggaccggggugacccagaacggcaccuccucggccugcauccgccgguccaacaacagcuucuucucccgccugaacuggcucacgcaccuccgguucaaguaccccgcccugaacgugaccaugcccaacaacgaggaguucgacaagcuguacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcucguccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagucgacccaggcggccaucgaccagaucaacgggaagcugaaccgccugaucggcaagaccaacgagaaguuccaccagaucgagaaggaguucuccgagaucgagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 7240 - RNA, 1701 nt, Artificial Sequence
  derived and/or modified CDS sequence (AUadapt) from InfluenzaA__AEK98402__HA
augaagaccaucaucgcccugucguacauccucugccugggcuucgcccagaagcugcccgggaacgacaacuccaccgcgacgcucugccugggccaccacgccgugccgaacgggaccaucgucaagaccaucaccaacgaccagaucgaggugacgaacgccaccgagcuggugcagucguccagcaccggcgagaucugcgacucgccccaccagauccucgacgggaagaacugcacccugaucgacgcccugcucggcgacccccagugcgacggcuuccagaacaagaagugggaccuguucgucgagcgcucgaaggccuacuccaacugcuaccccuacgacgugccggacuacgcgagccugcggucccucguggccucguccgggacgcuggaguucaacaacgagucguucaacuggaccggcgucacccagaacgggaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccucgggccggaucaccgucuccacgaagcgcagccagcagaccgccaucccgaacaucggcucgcggccccgcgugcggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacucggagugcaucacgcccaacggguccauccccaacgacaagccguuccagaacgucaaccgcaucaccuacggcgcgugcccccgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggccgggggcaggccgcggaccugaaguccacccaggccgccaucaaccagaucaacggcaagcugaaccgccucaucggcaagaccaacgagaaguuccaccagaucgagaaggaguucucggagguggaggggcggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggcgugccagaagggcaacauccggugcaacaucugcaucuga

SEQ ID NO: 7241 - RNA, 1701 nt, Artificial Sequence
  derived and/or modified CDS sequence (AUadapt) from InfluenzaA__AEK98404__HA
augaagaccaucaucgcccugucguacauccucucccugguguucgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgagaacuucaacuggaccggggugacccagaacggcaccuccucggccugcauccgccgguccaacaacucguucuucucccgccugaacuggcucacgcaccuccgguucaaguaccccgcccugaacgugaccaugcccaacaacgaggaguucgacaagcuguacaucuggggcguccaccaccccgggaccgacaacgaccagaucuuccuguacgcgcaggccagcgggcgcaucaccguguccacgaagcggucgcagcagaccgugaucccgaacaucggcagccgcccccggguccgcaacauccccucccggaucucgaucuacuggaccaucgugaagcccggcgacauccugcucaucaacuccaccgggaaccugaucgccccgcgcggcuacuucaagaugcggagcgggaaguccucgaucaugcgcuccgacgcccccaucggcaagugcaacucggagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 7242 - RNA, 1701 nt, Artificial Sequence
  derived and/or modified CDS sequence (AUadapt) from InfluenzaA__AEK98406__HA
augaagaccaucaucgcccugucguacauccucucccugguguucgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgagaacuucaacuggaccggggugacccagaacggcaccuccagcgccugcauccgccgguccaacaacucguucuucucccgccugaacuggcucacgcaccuccgguucaaguaccccgcccugaacgugaccaugcccaacaacgaggagcuggacaagcuguacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucucgaucuacuggaccaucgugaagcccggcgacauccuccugaucaacuccaccgggaaccugaucgccccgcgcggcuacuucaagauccggagcgggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcucaaccgccugaucggcaagaccaacgagaaguuccaccagaucgagaaggaguucucggaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagucgggcuacaaggacuggauccuguggaucuccuucgccaucagcugcuuccugcugugcguggcccuccugggcuucgucaugugggccugccagaaggggaacauccggugcaacaucugcaucuga

SEQ ID NO: 7243 - RNA, 1701 nt, Artificial Sequence
  derived and/or modified CDS sequence (AUadapt) from InfluenzaA__AEL11687__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcuccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgugaccgacaacgaccagauccggcuguacgcccaggcguccgggcgcaucaccgugucgacgaagcggagccagcagaccgucaucccgaacaucggcuaccgcccccgggugcgcgacauccccucccggaucucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacagcgagugcaucacgcccaacggcuccauccccaacgacaagccguuccagaacgucaaccggaucaccuacggggccugcccccgcuacgugaagcagaacacccugaagcucgccaccggcaugcggaacgugcccgagaagcagacgcgcgggaucuucggcgcgaucgccggguucaucgagaacggcugggagggcauggucgacgggugguacggcuuccggcaccagaacucggaggggaucggccaggccgccgaccugaaguccacccaggccgcgaucaaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagcgcaccaagaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaaggggguggagcugaaguccggcuacaaggacuggauccuguggaucuccuucgccaucagcugcuuccuccugugcgucgugcugcucggcuucaucaugugggccugccagaaggggaacauccgcugcaacaucugcaucuga

SEQ ID NO: 7244 - RNA, 1692 nt, Artificial Sequence
  derived and/or modified CDS sequence (AUadapt) from InfluenzaA__AEL31632__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccgggaacuucaacgacuacgaggagcucaagcaccuccugucccggaucaaccacuucgagaagauccagaucauccccaagagcuccuggucggaccacgaggccuccggcgucagcuccgugugccccuaccagggccgcucguccuucuuccggaacguggucuggcugaccaagaaggacaacgccuaccccacgaucaagcgcagcuacaacaacaccaaccaggaggaccugcuggugcucugggggauccaccaccccaacgacgcggccgagcagacccggcuguaccagaacccgaccacguacaucuccgugggcaccucgacccugaaccagcgccucguccccaagaucgccacccgguccaaggugaacgggcagagcggccgcauggaguucuucuggacgauccugaaguccaacgacgccaucaacuucgagucgaacgggaacuucaucgcgcccgagaacgccuacaagaucgugaagaagggcgacagcaccaucaugaaguccgagcuggaguacggcaacugcaacaccaagugccagacccccaucggggccaucaacucguccaugccguuccacaacauccacccccucacgaucggcgagugccccaaguacgucaagagcaaccggcuggugcuggccaccgggcuccgcaacuccccgcagggcgagacccggggccuguucggggccaucgcgggcuucaucgagggcggguggcaggggaugguggacggcugguacggcuaccaccacucgaacgagcagggguccggcuacgccgccgacaaggagagcacccagaaggccaucgacggggucacgaacaaggugaacuccaucaucgacaagaugaacacccaguucgaggccgugggccgcgaguucaacaaccuggagcggcgcaucgagaaccucaacaagaagauggaggacggguuccuggacgucuggaccuacaacgcggagcugcucgugcugauggagaacgagcggacccuggacuuccacgacucgaacgucaagaaccucuacgacaaggugcgccugcagcugcgggacaacgccaaggagcucggcaacggcugcuucgaguucuaccaccgcugcgacaacgagugcauggaguccgugcggaacgggacguacgacuacccgcaguacagcgaggaggcccgccugaagcgggaggagaucuccggcgucaagcuggagucgaucgggaccuaccagauccucuccaucuacagcaccguggccuccucgcuggcccuggcgaucaugguggccggccucuuccuguggaugugcuccaacgggagccugcagugccgcaucugcaucuga

SEQ ID NO: 7245 - RNA, 1701 nt, Artificial Sequence; identical to SEQ ID NO: 7165
  derived and/or modified CDS sequence (AUadapt) from InfluenzaA__AEL89297__HA

SEQ ID NO: 7246 - RNA, 1701 nt, Artificial Sequence; identical to SEQ ID NO: 7165
  derived and/or modified CDS sequence (AUadapt) from InfluenzaA__AEL89307__HA

SEQ ID NO: 7247 - RNA, 1701 nt, Artificial Sequence; identical to SEQ ID NO: 7165
  derived and/or modified CDS sequence (AUadapt) from InfluenzaA__AEL89317__HA

SEQ ID NO: 7248 - RNA, 1701 nt, Artificial Sequence; identical to SEQ ID NO: 7165
  derived and/or modified CDS sequence (AUadapt) from InfluenzaA__AEL89327__HA

SEQ ID NO: 7249 - RNA, 1701 nt, Artificial Sequence; identical to SEQ ID NO: 7165
  derived and/or modified CDS sequence (AUadapt) from InfluenzaA__AEL89337__HA

SEQ ID NO: 7250 - RNA, 1701 nt, Artificial Sequence; identical to SEQ ID NO: 7165
  derived and/or modified CDS sequence (AUadapt) from InfluenzaA__AEL89347__HA

SEQ ID NO: 7251 - RNA, 1701 nt, Artificial Sequence; identical to SEQ ID NO: 7165
  derived and/or modified CDS sequence (AUadapt) from InfluenzaA__AEL89357__HA

SEQ ID NO: 7252 - RNA, 1701 nt, Artificial Sequence; identical to SEQ ID NO: 7165
  derived and/or modified CDS sequence (AUadapt) from InfluenzaA__AEL89367__HA

SEQ ID NO: 7253 - RNA, 1701 nt, Artificial Sequence; identical to SEQ ID NO: 7165
  derived and/or modified CDS sequence (AUadapt) from InfluenzaA__AEL89391__HA

SEQ ID NO: 7254 - RNA, 1701 nt, Artificial Sequence; identical to SEQ ID NO: 7165
  derived and/or modified CDS sequence (AUadapt) from InfluenzaA__AEL89401__HA

SEQ ID NO: 7255 - RNA, 1701 nt, Artificial Sequence; identical to SEQ ID NO: 7165
  derived and/or modified CDS sequence (AUadapt) from InfluenzaA__AEL89411__HA

SEQ ID NO: 7256 - RNA, 1701 nt, Artificial Sequence; identical to SEQ ID NO: 7165
  derived and/or modified CDS sequence (AUadapt) from InfluenzaA__AEL89421__HA

SEQ ID NO: 7257 - RNA, 1701 nt, Artificial Sequence; identical to SEQ ID NO: 7165
  derived and/or modified CDS sequence (AUadapt) from InfluenzaA__AEL89441__HA

SEQ ID NO: 7258 - RNA, 1701 nt, Artificial Sequence; identical to SEQ ID NO: 7165
  derived and/or modified CDS sequence (AUadapt) from InfluenzaA__AEL89451__HA

SEQ ID NO: 7259 - RNA, 1701 nt, Artificial Sequence; identical to SEQ ID NO: 7165
  derived and/or modified CDS sequence (AUadapt) from InfluenzaA__AEL89461__HA

SEQ ID NO: 7260 - RNA, 1701 nt, Artificial Sequence; identical to SEQ ID NO: 7165
  derived and/or modified CDS sequence (AUadapt) from InfluenzaA__AEL89471__HA

SEQ ID NO: 7261 - RNA, 1701 nt, Artificial Sequence
  derived and/or modified CDS sequence (AUadapt) from InfluenzaA__AEL89481__HA
augaaggugauccuggucgugcuccuguacaccuucgccaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 7262 - RNA, 1701 nt, Artificial Sequence; identical to SEQ ID NO: 88
  derived and/or modified CDS sequence (AUadapt) from InfluenzaA__AEL89491__HA

SEQ ID NO: 7263 - RNA, 1701 nt, Artificial Sequence
  derived and/or modified CDS sequence (AUadapt) from InfluenzaA__AEL89501__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacgagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7264 - RNA, 1701 nt, Artificial Sequence; identical to SEQ ID NO: 4078
  derived and/or modified CDS sequence (AUadapt) from InfluenzaA__AEL89511__HA

SEQ ID NO: 7265 - RNA, 1701 nt, Artificial Sequence; identical to SEQ ID NO: 88
  derived and/or modified CDS sequence (AUadapt) from InfluenzaA__AEL89521__HA

SEQ ID NO: 7266 - RNA, 1701 nt, Artificial Sequence
  derived and/or modified CDS sequence (AUadapt) from InfluenzaA__AEL89531__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugccagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagauguuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7267 - RNA, 1701 nt, Artificial Sequence; identical to SEQ ID NO: 88
  derived and/or modified CDS sequence (AUadapt) from InfluenzaA__AEL89541__HA

SEQ ID NO: 7268 - RNA, 1701 nt, Artificial Sequence
  derived and/or modified CDS sequence (AUadapt) from InfluenzaA__AEL89551__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 7269 - RNA, 1701 nt, Artificial Sequence
  derived and/or modified CDS sequence (AUadapt) from InfluenzaA__AEL89561__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccgaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcaccgagaucuaccagauccuggcgaucuacuccaccgucgccucgagccuggugcucguggucucccugggcgccaucucguucuggaugugcuccaacggcagccugcagugccgcaucugcaucuga

SEQ ID NO: 7270 - RNA, 1701 nt, Artificial Sequence; identical to SEQ ID NO: 88
  derived and/or modified CDS sequence (AUadapt) from InfluenzaA__AEL89571__HA

SEQ ID NO: 7271 - RNA, 1701 nt, Artificial Sequence
  derived and/or modified CDS sequence (AUadapt) from InfluenzaA__AEL89581__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7272 - RNA, 1701 nt, Artificial Sequence; identical to SEQ ID NO: 6699
  derived and/or modified CDS sequence (AUadapt) from InfluenzaA__AEL89591__HA

SEQ ID NO: 7273 - RNA, 1701 nt, Artificial Sequence
  derived and/or modified CDS sequence (AUadapt) from InfluenzaA__AEL89601__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccacccgcccacgucggcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaaggugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 7274 - RNA, 1701 nt, Artificial Sequence; identical to SEQ ID NO: 6699
  derived and/or modified CDS sequence (AUadapt) from InfluenzaA__AEL89611__HA

SEQ ID NO: 7275 - RNA, 1701 nt, Artificial Sequence; identical to SEQ ID NO: 7141
  derived and/or modified CDS sequence (AUadapt) from InfluenzaA__AEL89621__HA

SEQ ID NO: 7276 - RNA, 1701 nt, Artificial Sequence; identical to SEQ ID NO: 88
  derived and/or modified CDS sequence (AUadapt) from InfluenzaA__AEL89631__HA

SEQ ID NO: 7277 - RNA, 1701 nt, Artificial Sequence; identical to SEQ ID NO: 7165
  derived and/or modified CDS sequence (AUadapt) from InfluenzaA__AEL89641__HA

SEQ ID NO: 7278 - RNA, 1701 nt, Artificial Sequence
  derived and/or modified CDS sequence (AUadapt) from InfluenzaA__AEL89651__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcguguucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccacggccgaccagcagucccuguaccagaacgccgacgccuacguguucgucggcaccucgcgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguucgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgucccuggugcucgucgugagccugggggccaucucguucuggaugugcuccaacggcagccugcagugccggaucugcaucuga

SEQ ID NO: 7279 - RNA, 1701 nt, Artificial Sequence; identical to SEQ ID NO: 6680
  derived and/or modified CDS sequence (AUadapt) from InfluenzaA__AEL89661__HA

SEQ ID NO: 7280 - RNA, 1701 nt, Artificial Sequence
  derived and/or modified CDS sequence (AUadapt) from InfluenzaA__AEL89671__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagucggccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucucggacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 7281 - RNA, 1701 nt, Artificial Sequence; identical to SEQ ID NO: 6680
  derived and/or modified CDS sequence (AUadapt) from InfluenzaA__AEL89691__HA

SEQ ID NO: 7282 - RNA, 1701 nt, Artificial Sequence
  derived and/or modified CDS sequence (AUadapt) from InfluenzaA__AEL89701__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccacccgcccacgucggcggaccagcagaaccuguaccagaacgccgacgccuacguguucgugggcaccucccgguacucgaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacaccccggugcacgacugcaacacgaccugccagacccccaagggcgccaucaacaccucccugcccuuccagaacauccaccccaucaccaucgggaagugcccgaaguacgucaagucgaccaagcugcggcucgccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacggcaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcaccaugaucuaccagauccuggccaucuacuccaccgucgcgucgucccuggugcucguggucagccugggcgccaucucguucuggaugugcuccaacggcagccugcagugccgcaucugcaucuga

SEQ ID NO: 7283 - RNA, 1701 nt, Artificial Sequence; identical to SEQ ID NO: 7282
  derived and/or modified CDS sequence (AUadapt) from InfluenzaA__AEL89711__HA

SEQ ID NO: 7284 - RNA, 1701 nt, Artificial Sequence; identical to SEQ ID NO: 6680
  derived and/or modified CDS sequence (AUadapt) from InfluenzaA__AEL89721__HA

SEQ ID NO: 7285 - RNA, 1701 nt, Artificial Sequence
  derived and/or modified CDS sequence (AUadapt) from InfluenzaA__AEL89741__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacaccuacguguucgugggcaccucgcgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgccuucgcgauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 7286 - RNA, 1701 nt, Artificial Sequence; identical to SEQ ID NO: 88
  derived and/or modified CDS sequence (AUadapt) from InfluenzaA__AEL89751__HA

SEQ ID NO: 7287 - RNA, 1701 nt, Artificial Sequence
  derived and/or modified CDS sequence (AUadapt) from InfluenzaA__AEL89761__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccaccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccacccgcccacgagcgcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacggcaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccaccaugaucuaccagauccuggccaucuacucgaccgucgcguccagccuggugcucguggucucgcugggcgccaucuccuucuggaugugcagcaacggcucccugcagugccgcaucugcaucuga

SEQ ID NO: 7288 - RNA, 1701 nt, Artificial Sequence; identical to SEQ ID NO: 7165
  derived and/or modified CDS sequence (AUadapt) from InfluenzaA__AEL89771__HA

SEQ ID NO: 7289 - RNA, 1701 nt, Artificial Sequence; identical to SEQ ID NO: 7287
  derived and/or modified CDS sequence (AUadapt) from InfluenzaA__AEL89781__HA

SEQ ID NO: 7290 - RNA, 1701 nt, Artificial Sequence; identical to SEQ ID NO: 6680
  derived and/or modified CDS sequence (AUadapt) from InfluenzaA__AEL89791__HA

SEQ ID NO: 7291 - RNA, 1701 nt, Artificial Sequence
  derived and/or modified CDS sequence (AUadapt) from InfluenzaA__AEL89801__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcguguucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccacggccgaccagcagucccuguaccagaacgccgacgccuacguguucgucggcaccucgcgguacuccaagaaguucaagcccgagaucgccgugcgcccgaaggugcgggaccaggagggccgcaugaacuacuacuggacccuggucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccgaagggcgccaucaacaccucgcugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcucgggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgucccugauccucgucgugagccugggggccaucucguucuggaugugcuccaacggcagccugcagugccggaucugcaucuga

SEQ ID NO: 7292 - RNA, 1701 nt, Artificial Sequence
  derived and/or modified CDS sequence (AUadapt) from InfluenzaA__AEL89812__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccaccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggucgggcaucaucaucuccgacaccccggugcacgacugcaacgcgaccugccagacccccaagggcgugaucaacacgagccugcccuuccagaacauccaccccaucaccaucgggaagugcccgaaguacgucaaguccaccaagcugcggcucgccaccggccugcgcaacgugcccucgauccagucccgggggcuguucggcgccaucgccggguucaucgagggcggcuggacggggaugguggacggcugguacggguaccaccaccagaacgagcagggcagcggguacgccgccgaccucaaguccacccagaacgccaucgacggcaucaccaacaaggucaacucggugaucgagaagaugaacacccaguucacggcggucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggucaagcucgaguccaccaugaucuaccagauccuggccaucuacagcaccguggcguccucgcuggugcucgucgugagccugggcgccaucuccuucuggaugugcagcaacggcucccugcagugccgcaucugcaucuga

SEQ ID NO: 7293 - RNA, 1701 nt, Artificial Sequence; identical to SEQ ID NO: 6680
  derived and/or modified CDS sequence (AUadapt) from InfluenzaA__AEL89832__HA

SEQ ID NO: 7294 - RNA, 1701 nt, Artificial Sequence
  derived and/or modified CDS sequence (AUadapt) from InfluenzaA__AEL89842__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacgacgggaagcugugcaagcugcgcggcgucgcgccccuccaccuggggaagugcaacaucgccggcuggauccuggggaacccggagugcgagucgcucuccaccgccagcuccuggucguacaucguggagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucucggacacgcccgugcacgacugcaacgcgaccugccagaccccgaagggcgccaucaacaccucccugcccuuccagaacgugcaccccaucacgaucgggaagugccccaaguacgucaagagcaccaagcuccggcuggccaccggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagucgacgcagaacgccaucgacaagaucaccaacaaggucaacuccgugaucgagaagaugaacacccaguucaccgccgucggcaaggaguucaaccaccuggagaagcgcaucgagaaccucaacaagaagguggacgacggcuuccuggacaucuggacguacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgggaggagaucgacggcgucaagcuggagagcacccgcaucuaccagauccuggccaucuacuccaccguggccucgagccucgugcuggucgugucccugggggccaucucguucuggaugugcuccaacggcagccuccagugccggaucugcaucuga

SEQ ID NO: 7295 - RNA, 1701 nt, Artificial Sequence
  derived and/or modified CDS sequence (AUadapt) from InfluenzaA__AEL89852__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggcgaucuacuccaccgucgccucgagccucgugcugguggucucccugggggccaucucguucuggaugugcuccaacggcagccuccagugccgcaucugcaucuga

SEQ ID NO: 7296 - RNA, 1701 nt, Artificial Sequence; identical to SEQ ID NO: 6699
  derived and/or modified CDS sequence (AUadapt) from InfluenzaA__AEL93568__HA

SEQ ID NO: 7297 - RNA, 1701 nt, Artificial Sequence; identical to SEQ ID NO: 6680
  derived and/or modified CDS sequence (AUadapt) from InfluenzaA__AEL93578__HA

SEQ ID NO: 7298 - RNA, 1701 nt, Artificial Sequence
  derived and/or modified CDS sequence (AUadapt) from InfluenzaA__AEL93598__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcguguucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccacggccgaccagcagucccuguaccagaacgccgacgccuacguguucgucggcaccucgcgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgucccuggugcucgucgugagccugggggccaucucguucuggaugugcuccaacggcagccugcagugccggaucugcaucuga

SEQ ID NO: 7299 - RNA, 1701 nt, Artificial Sequence
  derived and/or modified CDS sequence (AUadapt) from InfluenzaA__AEL93618__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccacggccgaccagcagucccucuaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccgggucgggcaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcggcuggccaccggccuccgcaacgucccgucgauccagucccgggggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgccaucuacuccaccgucgcgucgucccuggugcugguggucagccucggggccaucucguucuggaugugcuccaacggcagccugcagugccggaucugcaucuga

SEQ ID NO: 7300 - RNA, 1701 nt, Artificial Sequence; identical to SEQ ID NO: 6680
  derived and/or modified CDS sequence (AUadapt) from InfluenzaA__AEL93628__HA

SEQ ID NO: 7301 - RNA, 1701 nt, Artificial Sequence; identical to SEQ ID NO: 7115
  derived and/or modified CDS sequence (AUadapt) from InfluenzaA__AEL93638__HA

SEQ ID NO: 7302 - RNA, 1701 nt, Artificial Sequence
  derived and/or modified CDS sequence (AUadapt) from InfluenzaA__AEL94870__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucaagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 7303 - RNA, 1701 nt, Artificial Sequence
  derived and/or modified CDS sequence (AUadapt) from InfluenzaA__AEL95426__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacgcagaacgccaucgacaagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 7304 - RNA, 1701 nt, Artificial Sequence
  derived and/or modified CDS sequence (AUadapt) from InfluenzaA__AEL97631__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucaagcgcuucgagaucuuccccaagaccucguccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaccaccaucgggaagugccccaaguacgucaagagcaccaagcugcggcuggcgacgggccuccgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 7305 - RNA, 1701 nt, Artificial Sequence
  derived and/or modified CDS sequence (AUadapt) from InfluenzaA__AEL99664__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucaagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacguccguccacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacgugcccucgauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 7306 - RNA, 1701 nt, Artificial Sequence
  derived and/or modified CDS sequence (AUadapt) from InfluenzaA__AEL99674__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaucuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 7307 - RNA, 1689 nt, Artificial Sequence; identical to SEQ ID NO: 6516
  derived and/or modified CDS sequence (AUadapt) from InfluenzaA__AEM53455__HA

SEQ ID NO: 7308 - RNA, 1689 nt, Artificial Sequence; identical to SEQ ID NO: 1865
  derived and/or modified CDS sequence (AUadapt) from InfluenzaA__AEM53468__HA

SEQ ID NO: 7309 - RNA, 1698 nt, Artificial Sequence; identical to SEQ ID NO: 2360
  derived and/or modified CDS sequence (AUadapt) from InfluenzaA__AEM60037__HA

SEQ ID NO: 7310 - RNA, 1698 nt, Artificial Sequence
  derived and/or modified CDS sequence (AUadapt) from InfluenzaA__AEM60058__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggagagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcgagucguccuucuaccgcaaccugcuguggcucaccgggaagaacggccuguaccccaaccugagcaaguccuacgccaacaacaaggagaaggacgugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucgggcgcggcuucggcuccgggaucaucacgagcaacgcccccauggacaagugcgacgcgaagugccagacgccccagggcgccaucaacuccagccugcccuuccagaacguccacccggugaccaucggggagugccccaaguacgugcgguccaccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcucgggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgcgagaagaucgacggcgugaagcuggagucgaugggggucuaccagauccuggcgaucuacuccaccguggccagcagccucgugcugcuggucucccucggcgccaucagcuucuggaugugcuccaacgggagccugcagugccggaucugcaucuga

SEQ ID NO: 7311 - RNA, 1701 nt, Artificial Sequence
  derived and/or modified CDS sequence (AUadapt) from InfluenzaA__AEM60069__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccucguccggcacgcuggaguucaucaacgaggacuucaacuggaccggggugacccagagcggcggguccuacgccugcaagcgcggcucggugaaguccuucuucagccggcugaacuggcuccacgaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugucgaccaagcggagccagcagacggugaucccgaacaucgggucccgccccuggguccggggccugucgucccgcaucagcaucuacuggaccaucgugaagcccggggacauccugcucaucaacuccaccggcaaccugaucgcgccccggggcuacuucaagauccgcaccgggaaguccuccaucaugcggucggacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacucggagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacucggagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 7312 - RNA, 1701 nt, Artificial Sequence
  derived and/or modified CDS sequence (AUadapt) from InfluenzaA__AEM92308__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaagcggaacucguaccccaagcuguccaagagcuacaucaacgacaaggggaaggaggugcugguccucuggggcauccaccaccccucgaccuccgccgaccagcagagccuguaccagaacgccgacgccuacguguucgugggguccucgcgcuacuccaagaaguucaagcccgagaucgccauccggccgaagguccgcgaccaggagggccggaugaacuacuacuggacgcugguggagcccggcgacaagaucaccuucgaggcgaccgagaaccucguggucccccgcuacgccuucgccauggagcggaacgccgggagcggcaucaucaucuccgacacccccgugcacgacugcaacacgaccugccagaccccgaagggggccaucaacaccucgcugcccuuccagaacauccaccccaucacgaucggcaagugccccaaguacgugaaguccaccaagcugcgccucgcgaccggccugcggaacgucccgagcauccagucccgcgggcuguucggcgccaucgccggguucaucgagggcggguggaccggcaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggucgcagcugaagaacaacgccaaggaggugggcaacggcugcuucgaguucuaccacaagugcgacaacacgugcauggaguccgugaagaacgggaccuacgacuaccccaaguacagcgaggaggccaagcugaaccgcgaggagaucgacggcgucaagcucgaguccacccggaucuaccagauccuggcgaucuacucgaccgccgccagcucccuggugcucguggucucgcugggggccaucuccuucuggaugugcagcaacggcucccugcagugccgcaucugcaucuga

SEQ ID NO: 7313 - RNA, 1701 nt, Artificial Sequence
  derived and/or modified CDS sequence (AUadapt) from InfluenzaA__AEM92318__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgagaaguccuucuacaagaaccugaucuggcucgugaagaaggggaacagcuaccccaagcugaacaaguccuacaucaacgacaagggcaaggaggugcugguccucugggggauccaccaccccucgaccagcgcggaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccauccacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgugccgucgauccagucccgggggcuguucggcgcgaucgccggguucaucgagggcggcuggacggggauggucgacggcugguacggguaccaccaccagaacgagcagggcagcggguacgccgccgaccucaaguccacccagaacgccaucgacgagaucaccaacaaggugaacucggugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 7314 - RNA, 1701 nt, Artificial Sequence
  derived and/or modified CDS sequence (AUadapt) from InfluenzaA__AEM92328__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcugaacaucuccuacaucaacgacaagggcaaggaggugcugguccucugggggauccaccaccccucgaccacggccgaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucccugggggccaucucguucuggaugugcagcaacggcucccugcagugccggaucugcaucuga

SEQ ID NO: 7315 - RNA, 1701 nt, Artificial Sequence
  derived and/or modified CDS sequence (AUadapt) from InfluenzaA__AEM92348__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgagaaguccuucuacaagaaccugaucuggcucgugaagaaggggaacucguaccccaagcugaacaaguccuacaucaacgacaagggcaaggaggugcugguccucugggggauccaccaccccagcaccucggcggaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccauccacgacugcaacacgaccugccagaccccgaagggcgccaucaacaccucgcugcccuuccagaacauccaccccaucaccaucgggaagugccccaaguacgugaaguccaccaagcugcggcucgccaccggccugcgcaacgugccgagcauccagucccgggggcuguucggcgcgaucgccggguucaucgagggcggcuggacggggauggucgacggcugguacggguaccaccaccagaacgagcagggcucgggguacgccgccgaccucaaguccacccagaacgccaucgacgagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggucaagucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacucgaccguggcguccagccugguccucguggugucgcugggggccaucuccuucuggaugugcagcaacggcucccugcagugccgcaucugcaucuga

SEQ ID NO: 7316 - RNA, 1701 nt, Artificial Sequence
  derived and/or modified CDS sequence (AUadapt) from InfluenzaA__AEM92358__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaaggaggggaacagcuaccccaagcuguccaagucguacaucaacgacaagggcaaggaggugcugguccucugggggauccaccaccccagcaccacgaccgaccagcagucccuguaccagaacgccgacgccuacguguucgugggcaccucgcgguacuccaagaaguucaagcccgagaucgccauccgcccgaagaugcgggaccaggagggccgcaugaacuacuacuggacccuggucgagcccggggacaagaucacguucgaggccaccggcaaccucguggugccccgguacgcguucgccauggagcgcaacgccgggucgggcaucaucaucuccgacacccccguccacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 7317 - RNA, 1701 nt, Artificial Sequence
  derived and/or modified CDS sequence (AUadapt) from InfluenzaA__AEM92368__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacucgaccgucgccuccagccuggugcucguggucucccugggggccaucucguucuggaugugcagcaacggcucccugcagugccggaucugcaucuga

SEQ ID NO: 7318 - RNA, 1701 nt, Artificial Sequence
  derived and/or modified CDS sequence (AUadapt) from InfluenzaA__AEM92378__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccgacaacggcacgugcuaccccggcgacuucaucgacuacgaggagcuccgggagcagcugaacagcguguccucguucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugaacaagucguacaucaacgacaagggcaaggaggugcugguccucugggggauccaccaccccuccaccacggccgaccagcagucgcuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccucgucccuggugcucguggucagccugggggccaucuccuucuggaugugcucgaacggcagccugcagugccggaucugcaucuga

SEQ ID NO: 7319 - RNA, 1701 nt, Artificial Sequence
  derived and/or modified CDS sequence (AUadapt) from InfluenzaA__AEM92407__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccaacagcugguccuacaucguggagaccucguccagcgacaacggcacgugcuaccccggcgacuucaucgacuacgaggagcuccgggagcagcuguccucgguguccucguucgagcgcuucgagaucuuccccaagaccaacuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccuccaccucgacggaccagcagagccuguaccagaacgccgacgccuacguguucgugggcaccucccgguacucgaagaaguucaagcccgagaucgccauccgcccgaagguccggaaccaggagggccgcaugaacuacuacuggacccugguggagcccggggacaagaucaccuucgaggccacgggcaaccucguggucccccgguacgcguucaccaucgagcgcaacgccggguccggcaucaucaucucggacacccccauccacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggacccacaacgcggagcugcugguccuccuggagaacgagcggacgcuggacuaccacgacucgaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggccucgucccugguccucguggugagccugggggcgaucucguucuggaugugcuccaugggcagccugcagugccggaucugcaucuga

SEQ ID NO: 7320 - RNA, 1701 nt, Artificial Sequence
  derived and/or modified CDS sequence (AUadapt) from InfluenzaA__AEM92417__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaaggccagcuccuggcccaaccacgacucgaacaagggggucaccgccgccugcccgcacgcgggcgccaaguccuucuacaagaaccugaucuggcuggugaagaaggagaacagcuaccccaagcucuccaagucguacaucaacgacaaggggaaggaggugcugguccuguggggcauccaccaccccagcaccuccgccgaccagcagucgcucuaccagaacgccgacgccuacguguucgugggguccagccgguacuccaagaaguucaagcccgagaucgcgauccgcccgaagguccgggaccaggagggccgcaugaacuacuacuggacccugguggagcccggcgacaagaucacguucgaggccaccgggaaccugguggucccccgguacgccuucgccauggagcgcaacgccggcucggggaucaucaucuccgacacccccgugcacgacugcaacaccacgugccagaccccgaagggcgcgaucaacaccagccuccccuuccagaacauccaccccaucaccaucggcaagugccccaaguacgugaaguccacgaagcugcggcuggccaccgggcuccgcaacgucccgucgauccagucccggggccuguucggggccaucgccggcuucaucgagggcggguggaccggcaugguggacgggugguacggcuaccaccaccagaacgagcaggggagcggcuacgccgcggaccugaaguccacccagaacgccaucgacgagaucacgaacaaggugaacucggucaucgagaagaugaacacccaguucaccgccguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacucggaggaggcgaagcugaaccgggaggagaucgacggggugaagcuggaguccacccgcaucuaccagauccucgccaucuacagcaccgucgccucgucccuggugcugguggucagccucggcgccaucuccuucuggaugugcagcaacgggucccugcagugccggaucugcaucuga

SEQ ID NO: 7321 - RNA, 1701 nt, Artificial Sequence
  derived and/or modified CDS sequence (AUadapt) from InfluenzaA__AEM92428__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacaugugcauggagagcgugaagaacgggaccuacgacuaccccaaguacuccgaggaggccaagcugaaccgggaggagaucgacggcgugaagcucgagucgacgcgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 7322 - RNA, 1701 nt, Artificial Sequence
  derived and/or modified CDS sequence (AUadapt) from InfluenzaA__AEM92438__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagauccgcaaccagcugaagaacaacgccaaggagaucggcaacgggugcuucgaguucuaccacaagugcgacaacacgugcauggaguccgucaagaacggcaccuacgacuaccccaaguacucggaggaggccaagcugaaccgggaggagaucgacggggugaagcucgaguccacccgcaucuaccagauccuggccaucuacucgaccguggcguccagccugguccucguggugucccugggcgccaucucguucuggaugugcagcaacggcucccugcagugccggaucugcaucuga

SEQ ID NO: 7323 - RNA, 1701 nt, Artificial Sequence; identical to SEQ ID NO: 7054
  derived and/or modified CDS sequence (AUadapt) from InfluenzaA__AEM92448__HA

SEQ ID NO: 7324 - RNA, 1701 nt, Artificial Sequence; identical to SEQ ID NO: 7054
  derived and/or modified CDS sequence (AUadapt) from InfluenzaA__AEM92458__HA

SEQ ID NO: 7325 - RNA, 1701 nt, Artificial Sequence
  derived and/or modified CDS sequence (AUadapt) from InfluenzaA__AEM92468__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacguccaaguacagcaaggaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucucggacacgcccgugcacgacugcaacaccaucugccagaccccgaagggcgccaucaacaccucccugcccuuccagaacauccaccccaucacgaucgggaagugccccaaguacgucaagagcaccaagcuccgccuggcgaccggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcggaucgagaaccucaacaagaaggucgacgacggcuuccuggacaucuggacguacaacgccgagcugcucgugcugcuggagaacgagcgcacccucgacuaccacgacucgaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagucgacccggaucuaccagauccuggcgaucuacuccaccgucgccagcucgcucgugcugguggucucccugggggccaucagcuucuggaugugcuccaacggcagccuccagugccgcaucugcaucuga

SEQ ID NO: 7326 - RNA, 1701 nt, Artificial Sequence
  derived and/or modified CDS sequence (AUadapt) from InfluenzaA__AEM92478__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucucggacacgcccgugcacgacugcaacaccaucugccagaccccgaagggcgccaucaacaccucccugcccuuccagaacauccaccccaucacgaucgggaagugccccaaguacgucaagagcaccaagcuccgccuggcgaccggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcggaucgagaaccucaacaagaaggucgacgacggcuuccuggacaucuggacguacaacgccgagcugcucgugcugcuggagaacgagcgcacccucgacuaccacgacucgaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagucgacccggaucuaccagauccuggcgaucuacuccaccgucgccagcucgcucgugcugguggucucccugggggccaucagcuucuggaugugcuccaacggcagccuccagugccgcaucugcaucuga

SEQ ID NO: 7327 - RNA, 1701 nt, Artificial Sequence
  derived and/or modified CDS sequence (AUadapt) from InfluenzaA__AEM92498__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccaacagcugguccuacaucguggagaccucguccucggacaacggcacgugcuaccccggcgacuucaucgacuacgaggagcuccgggagcagcuguccagcguguccucguucgagcgcuucgagaucuuccccaagaccaacuccuggcccaaccacgacagcaacaagggggucaccgccgccugcccgcacgccggcgcgaaguccuucuacaagaaccugaucuggcucgugaagaaggggaacucguaccccaagcuguccaagucguacaucaacgacaagggcaaggaggugcugguccucugggggauccaccaccccuccaccagcgccgaccagcagucgcuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagucgaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagucgacccgcaucuaccagauccuggccaucuacuccaccguggccucgucccugguccucguggugagccugggggccaucucguucuggaugugcuccaacggcagccugcagugccggaucugcaucuga

SEQ ID NO: 7328 - RNA, 1701 nt, Artificial Sequence
  derived and/or modified CDS sequence (AUadapt) from InfluenzaA__AEM92518__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagcggaaggaggugcugguccucuggggcauccaccacccgcccacgucggcggaccagcagucccuguaccagaacgccgacgccuacguguucguggggaccucgcgcuacuccaagaaguucaagcccgagaucgccauccggcccaagguccgcgaccaggagggccggaugaacuacuacuggacccugguggagcccggcgacaagaucaccuucgaggccacggggaaccucguggucccccgcuacgcguucgccauggagcggaacgccggcagcgggaucaucaucuccgacaccccggugcacgacugcaacgcgaccugccagacccccaagggcgccaucaacacgucgcugcccuuccagaacauccaccccaucaccaucggcaagugcccgaaguacgugaaguccaccaagcugcgccucgccaccgggcugcggaacguccccagcauccagucccgcggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaaggugaagaaccucuacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacucgaccgucgccuccagccuggugcucguggucucgcugggcgccaucuccuucuggaugugcagcaacgggucccugcagugccgcaucugcaucuga

SEQ ID NO: 7329 - RNA, 1701 nt, Artificial Sequence
  derived and/or modified CDS sequence (AUadapt) from InfluenzaA__AEM92528__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggccuucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgucccuggugcucguggucagccugggggccaucucguucuggaugugcuccaacggcagccugcagugccggaucugcaucuga

SEQ ID NO: 7330 - RNA, 1701 nt, Artificial Sequence
  derived and/or modified CDS sequence (AUadapt) from InfluenzaA__AEM92548__HA
augaaggccauccuggugguccuccuguacaccuucgccaccgcgacggccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgacguccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7331 - RNA, 1701 nt, Artificial Sequence
  derived and/or modified CDS sequence (AUadapt) from InfluenzaA__AEM92558__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcucgaucgccggcuggauccuggggaacccggagugcgagucccugagcaccgcguccucgugguccuacaucguggagaccagcuccucggacaacggcacgugcuaccccggcgacuucaucaacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaagucguacaucaacgacaagggcaaggaggugcugguccucugggggauccaccaccccuccaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7332 - RNA, 1701 nt, Artificial Sequence; identical to SEQ ID NO: 7331
  derived and/or modified CDS sequence (AUadapt) from InfluenzaA__AEM92568__HA

SEQ ID NO: 7333 - RNA, 1701 nt, Artificial Sequence
  derived and/or modified CDS sequence (AUadapt) from InfluenzaA__AEM92578__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaucagcgacaacggcacgugcuaccccggcgacuucaucaacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 7334 - RNA, 1701 nt, Artificial Sequence
  derived and/or modified CDS sequence (AUadapt) from InfluenzaA__AEM92608__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 7335 - RNA, 1701 nt, Artificial Sequence
  derived and/or modified CDS sequence (AUadapt) from InfluenzaA__AEM92618__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccaacagcugguccuacaucguggagaccucguccucggacaacggcacgugcuaccccggcgacuucaucgacuacgaggagcuccgggagcagcuguccagcguguccucguucgagcgcuucgagaucuuccccaagaccaacuccuggcccaaccacgacagcaacaagggggucaccgccgccugcccgcacgccggcgcgaaguccuucuacaagaaccugaucuggcucgugaagaccgggaacucguaccccaagcuguccaagucguacaucaacgacaagggcaaggaggugcugguccucugggggauccaccaccccuccacgagcgccgaccagcagucgcuguaccagaacgccgacgccuacguguucgugggcaccucccgguacucgcgcaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccggguccggcaucaucaucagcgacacccccgcccacgacugcaacacgaccugccagaccccgaagggcgcgaucaacaccucccugcccuuccagaacauccaccccaucaccaucgggaagugccccaaguacgucaagucgaccaagcugcgccucgccacgggccugcggaacgugccguccauccagagccgcgggcuguucggcgccaucgccggguucaucgagggcggcuggaccgggaugguggacggcugguacggguaccaccaccagaacgagcagggcuccggguacgccgcggaccucaagucgacccagaacgccaucgacaagaucaccaacaaggugaacuccgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacucgaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgcgaggagaucgacggcgugaagcucgagucgacccggaucuaccagauccuggccaucuacuccaccguggccucgucccugguccucguggugagccugggggccaucucguucuggaugugcuccaacggcagccugcagugccgcaucugcaucuga

SEQ ID NO: 7336 - RNA, 1701 nt, Artificial Sequence
  derived and/or modified CDS sequence (AUadapt) from InfluenzaA__AEM92638__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgcgagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacaccaacaagggggucaccgccgccugcccgcacgccggcgccaagucguucuacaagaaccugaucuggcuggugaagaaggggaacuccuaccccaagcucagcaaguccuacaucaacgacaagggcaaggaggugcugguccugugggggauccaccaccccucgacgagcgccgaccagcagucccucuaccagaacgccgacgccuacguguucgugggcucgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagaagaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagucgcgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagguggggaacggcugcuucgaguucuaccacaagugcgacaacacgugcauggagucggugaagaacgggaccuacgacuaccccaaguacuccgaggaggccaagcugaaccgcgaggagaucgacggcgucaagcuggagagcacccggaucuaccagauccucgcgaucuacuccaccgccgccucgagccuggugcugguggucucccucggggccaucucguucuggaugugcuccaacggcagccugcagugccgcaucugcaucuga

SEQ ID NO: 7337 - RNA, 1701 nt, Artificial Sequence
  derived and/or modified CDS sequence (AUadapt) from InfluenzaA__AEM92648__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgcgagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacaccaacaagggggucaccgccgccugcccgcacgccggcgccaagucguucuacaagaaccugaucuggcuggugaaggaggggaacuccuaccccaagcucagcaaguccuacaucaacgacaagggcaaggaggugcugguccugugggggauccaccaccccucgacgagcgccgaccagcagucccucuaccagaacgccgacgccuacguguucgugggcucgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagaagaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagucgcgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagguggggaacggcugcuucgaguucuaccacaagugcgacaacacgugcauggagucggugaagaacgggaccuacgacuaccccaaguacuccgaggaggccaagcugaaccgcgaggagaucgacggcgucaagcuggagagcacccggaucuaccagauccucgcgaucuacuccaccgccgccucgagccuggugcugguggucucccucggggccaucucguucuggaugugcuccaacggcagccugcagugccgcaucugcaucuga

SEQ ID NO: 7338 - RNA, 1701 nt, Artificial Sequence; identical to SEQ ID NO: 5778
  derived and/or modified CDS sequence (AUadapt) from InfluenzaA__AEM98407__HA

SEQ ID NO: 7339 - RNA, 1701 nt, Artificial Sequence; identical to SEQ ID NO: 5778
  derived and/or modified CDS sequence (AUadapt) from InfluenzaA__AEM98418__HA

SEQ ID NO: 7340 - RNA, 1701 nt, Artificial Sequence; identical to SEQ ID NO: 5778
  derived and/or modified CDS sequence (AUadapt) from InfluenzaA__AEM98429__HA

SEQ ID NO: 7341 - RNA, 1701 nt, Artificial Sequence
  derived and/or modified CDS sequence (AUadapt) from InfluenzaA__AEN55398__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgugaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7342 - RNA, 1701 nt, Artificial Sequence; identical to SEQ ID NO: 7165
  derived and/or modified CDS sequence (AUadapt) from InfluenzaA__AEN55408__HA

SEQ ID NO: 7343 - RNA, 1701 nt, Artificial Sequence; identical to SEQ ID NO: 6680
  derived and/or modified CDS sequence (AUadapt) from InfluenzaA__AEN55418__HA

SEQ ID NO: 7344 - RNA, 1701 nt, Artificial Sequence; identical to SEQ ID NO: 88
  derived and/or modified CDS sequence (AUadapt) from InfluenzaA__AEN55463__HA

SEQ ID NO: 7345 - RNA, 1701 nt, Artificial Sequence
  derived and/or modified CDS sequence (AUadapt) from InfluenzaA__AEN55473__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacgaccgaccagcagucccuguaccagaccgccgacaccuacguguucgugggcacgucgcgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgccuucgcgauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaccaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 7346 - RNA, 1701 nt, Artificial Sequence; identical to SEQ ID NO: 6680
  derived and/or modified CDS sequence (AUadapt) from InfluenzaA__AEN55483__HA

SEQ ID NO: 7347 - RNA, 1701 nt, Artificial Sequence; identical to SEQ ID NO: 7287
  derived and/or modified CDS sequence (AUadapt) from InfluenzaA__AEN55493__HA

SEQ ID NO: 7348 - RNA, 1701 nt, Artificial Sequence; identical to SEQ ID NO: 6680
  derived and/or modified CDS sequence (AUadapt) from InfluenzaA__AEN55503__HA

SEQ ID NO: 7349 - RNA, 1701 nt, Artificial Sequence
  derived and/or modified CDS sequence (AUadapt) from InfluenzaA__AEN55513__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagaaccuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucucggacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 7350 - RNA, 1701 nt, Artificial Sequence; identical to SEQ ID NO: 6680
  derived and/or modified CDS sequence (AUadapt) from InfluenzaA__AEN55523__HA

SEQ ID NO: 7351 - RNA, 1701 nt, Artificial Sequence; identical to SEQ ID NO: 5469
  derived and/or modified CDS sequence (AUadapt) from InfluenzaA__AEN68904__HA

SEQ ID NO: 7352 - RNA, 1701 nt, Artificial Sequence; identical to SEQ ID NO: 116
  derived and/or modified CDS sequence (AUadapt) from InfluenzaA__AEN68905__HA

SEQ ID NO: 7353 - RNA, 1701 nt, Artificial Sequence; identical to SEQ ID NO: 116
  derived and/or modified CDS sequence (AUadapt) from InfluenzaA__AEN68906__HA

SEQ ID NO: 7354 - RNA, 1701 nt, Artificial Sequence; identical to SEQ ID NO: 4016
  derived and/or modified CDS sequence (AUadapt) from InfluenzaA__AEN68907__HA

SEQ ID NO: 7355 - RNA, 1701 nt, Artificial Sequence; identical to SEQ ID NO: 116
  derived and/or modified CDS sequence (AUadapt) from InfluenzaA__AEN68908__HA

SEQ ID NO: 7356 - RNA, 1701 nt, Artificial Sequence
  derived and/or modified CDS sequence (AUadapt) from InfluenzaA__AEN68909__HA
augaaggccauccuggugguccuccuguacaccuucgccaccgcgaacgccgacacgcugugcgugggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 7357 - RNA, 1701 nt, Artificial Sequence
  derived and/or modified CDS sequence (AUadapt) from InfluenzaA__AEN68910__HA
augaaggccauccuggugguccuccuguacaccuucgccaccgcgaacgccgacacgcugugcgugggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagggcaccaagcugcggcucgcgaccgggcugcgcaacgugccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggucaagcucgaguccacccgcaucuaccagauccuggcgaucuacucgaccguggccuccagccuggugcucgucgugucgcugggcgccaucuccuucuggaugugcagcaacggcucccugcagugccggaucugcaucuga

SEQ ID NO: 7358 - RNA, 1701 nt, Artificial Sequence; identical to SEQ ID NO: 5030
  derived and/or modified CDS sequence (AUadapt) from InfluenzaA__AEN68911__HA

SEQ ID NO: 7359 - RNA, 1701 nt, Artificial Sequence; identical to SEQ ID NO: 116
  derived and/or modified CDS sequence (AUadapt) from InfluenzaA__AEN68912__HA

SEQ ID NO: 7360 - RNA, 1701 nt, Artificial Sequence; identical to SEQ ID NO: 3005
  derived and/or modified CDS sequence (AUadapt) from InfluenzaA__AEN68913__HA

SEQ ID NO: 7361 - RNA, 1701 nt, Artificial Sequence; identical to SEQ ID NO: 5580
  derived and/or modified CDS sequence (AUadapt) from InfluenzaA__AEN68914__HA

SEQ ID NO: 7362 - RNA, 1701 nt, Artificial Sequence; identical to SEQ ID NO: 116
  derived and/or modified CDS sequence (AUadapt) from InfluenzaA__AEN68915__HA

SEQ ID NO: 7363 - RNA, 1701 nt, Artificial Sequence; identical to SEQ ID NO: 116
  derived and/or modified CDS sequence (AUadapt) from InfluenzaA__AEN68916__HA

SEQ ID NO: 7364 - RNA, 1701 nt, Artificial Sequence
  derived and/or modified CDS sequence (AUadapt) from InfluenzaA__AEN68917__HA
augaaggccauccugggcgugcuccuguacaccuucgccaccgcgaacgccgacacgcugugcaucggguaccacgccaacaacucgaccgacaccgucgacaccgugcucgagaagaacgugacggucacccacuccgugaaccugcuggaggacaagcacaacggcaagcucugcaagcugcgcgggguggcgccccugcaccucggcaagugcaacaucgccggguggauccugggcaacccggagugcgagucgcuguccaccgccagcuccuggucguacaucgucgagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacucgaacaagggcgugaccgccgccugcccgcacgccggggcgaaguccuucuacaagaaccugaucuggcucgucaagaagggcaacagcuaccccaagcuguccaagucguacaucaacgacaaggggaaggaggugcuggugcucuggggcauccaccaccccagcaccuccgccgaccagcagucgcuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucucggacacgcccguccacgacugcaacacgaccugccagaccccgaagggggccaucaacaccucccugcccuuccagaacauccaccccgugaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 7365 - RNA, 1701 nt, Artificial Sequence
  derived and/or modified CDS sequence (AUadapt) from InfluenzaA__AEN68918__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagaacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagguggggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 7366 - RNA, 1701 nt, Artificial Sequence; identical to SEQ ID NO: 88
  derived and/or modified CDS sequence (AUadapt) from InfluenzaA__AEN68919__HA

SEQ ID NO: 7367 - RNA, 1701 nt, Artificial Sequence; identical to SEQ ID NO: 5078
  derived and/or modified CDS sequence (AUadapt) from InfluenzaA__AEN68920__HA

SEQ ID NO: 7368 - RNA, 1701 nt, Artificial Sequence; identical to SEQ ID NO: 4078
  derived and/or modified CDS sequence (AUadapt) from InfluenzaA__AEN68921__HA

SEQ ID NO: 7369 - RNA, 1701 nt, Artificial Sequence; identical to SEQ ID NO: 4074
  derived and/or modified CDS sequence (AUadapt) from InfluenzaA__AEN68922__HA

SEQ ID NO: 7370 - RNA, 1701 nt, Artificial Sequence; identical to SEQ ID NO: 4078
  derived and/or modified CDS sequence (AUadapt) from InfluenzaA__AEN68923__HA

SEQ ID NO: 7371 - RNA, 1701 nt, Artificial Sequence; identical to SEQ ID NO: 4078
  derived and/or modified CDS sequence (AUadapt) from InfluenzaA__AEN68924__HA

SEQ ID NO: 7372 - RNA, 1701 nt, Artificial Sequence
  derived and/or modified CDS sequence (AUadapt) from InfluenzaA__AEN68925__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucguggagacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 7373 - RNA, 1701 nt, Artificial Sequence
  derived and/or modified CDS sequence (AUadapt) from InfluenzaA__AEN68926__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuggccaccgccuccagcugguccuacaucguggagaccucgaacuccgacaacggcacgugcuaccccggcgacuucaucgacuacgaggagcuccgggagcagcugagcuccgugucguccuucgagcgcuucgagaucuuccccaagaccucguccuggcccaaccacgacagcaacaagggggucaccgccgccugcccgcacgcgggcgccaaguccuucuacaagaaccugaucuggcucgugaagaaggggaacucguaccccaagcuguccaagagcuacaucaacgacaagggccgggaggugcugguccucugggggauccaccaccccuccaccucggccgaccagcagagccuguaccagaacgccgacacguacguguucgugggcaccucccgcuacucgaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacucgaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgucccuggugcucguggucagccugggggccaucucguucuggaugugcuccaacggcagccugcagugccgcaucugcaucuga

SEQ ID NO: 7374 - RNA, 1701 nt, Artificial Sequence
  derived and/or modified CDS sequence (AUadapt) from InfluenzaA__AEN68927__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7375 - RNA, 1701 nt, Artificial Sequence; identical to SEQ ID NO: 6500
  derived and/or modified CDS sequence (AUadapt) from InfluenzaA__AEN68928__HA

SEQ ID NO: 7376 - RNA, 1701 nt, Artificial Sequence
  derived and/or modified CDS sequence (AUadapt) from InfluenzaA__AEN68929__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7377 - RNA, 1701 nt, Artificial Sequence; identical to SEQ ID NO: 88
  derived and/or modified CDS sequence (AUadapt) from InfluenzaA__AEN68930__HA

SEQ ID NO: 7378 - RNA, 1701 nt, Artificial Sequence; identical to SEQ ID NO: 88
  derived and/or modified CDS sequence (AUadapt) from InfluenzaA__AEN68931__HA

SEQ ID NO: 7379 - RNA, 1701 nt, Artificial Sequence; identical to SEQ ID NO: 88
  derived and/or modified CDS sequence (AUadapt) from InfluenzaA__AEN68932__HA

SEQ ID NO: 7380 - RNA, 1701 nt, Artificial Sequence
  derived and/or modified CDS sequence (AUadapt) from InfluenzaA__AEN69426__HA
augaaggccauccuggugguccuccuguacaccuucgccaccucgaacgcggacacgcugugcaucggcuaccacgccaacaacuccaccgacaccguggacaccgugcucgagaagaacgucacggugacccacucggugaaccugcuggaggacaagcacaacgggaagcucugcaagcugcgcggcgucgcgccccugcaccucgggaagugcaacaucgccggcuggauccuggggaacccggagugcgagucccugagcaccgccuccucgugguccuacaucguggagaccagcuccucggacaacggcacgugcuaccccggcaacuucaucgacuacgaggagcuccgggagcagcuguccagcguguccucguucgagcgcuucgagaucuuccccaagaccuccagcuggcccgaccacgacuccaacaagggggucaccgccgccugcccgcacgccggcgccaagucguucuacaagaaccugaucuggcucgugaagaaggggaacuccuaccccaagcugagcaagucguacaucaacgacaagggcaaggaggugcugguccucugggggauccaccaccccuccaccagcgcggaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggccaccggcaaccucguggcgccccgguacgccuucgccauggagcgcaacgccgggagcggcaucaucaucuccgacacgcccguccacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgugccgagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccagcucccugguccucguggugucgcugggggccaucuccuucuggaugugcagcaacggcucccugcagugccggaucugcaucuga

SEQ ID NO: 7381 - RNA, 1701 nt, Artificial Sequence; identical to SEQ ID NO: 7165
  derived and/or modified CDS sequence (AUadapt) from InfluenzaA__AEN69475__HA

SEQ ID NO: 7382 - RNA, 1701 nt, Artificial Sequence; identical to SEQ ID NO: 7165
  derived and/or modified CDS sequence (AUadapt) from InfluenzaA__AEN69481__HA

SEQ ID NO: 7383 - RNA, 1701 nt, Artificial Sequence; identical to SEQ ID NO: 3167
  derived and/or modified CDS sequence (AUadapt) from InfluenzaA__AEO01032__HA

SEQ ID NO: 7384 - RNA, 1701 nt, Artificial Sequence; identical to SEQ ID NO: 3267
  derived and/or modified CDS sequence (AUadapt) from InfluenzaA__AEO01033__HA

SEQ ID NO: 7385 - RNA, 1701 nt, Artificial Sequence; identical to SEQ ID NO: 3267
  derived and/or modified CDS sequence (AUadapt) from InfluenzaA__AEO01034__HA

SEQ ID NO: 7386 - RNA, 1701 nt, Artificial Sequence; identical to SEQ ID NO: 62
  derived and/or modified CDS sequence (AUadapt) from InfluenzaA__AEO01035__HA

SEQ ID NO: 7387 - RNA, 1701 nt, Artificial Sequence; identical to SEQ ID NO: 3267
  derived and/or modified CDS sequence (AUadapt) from InfluenzaA__AEO01036__HA

SEQ ID NO: 7388 - RNA, 1701 nt, Artificial Sequence; identical to SEQ ID NO: 3156
  derived and/or modified CDS sequence (AUadapt) from InfluenzaA__AEO01037__HA

SEQ ID NO: 7389 - RNA, 1701 nt, Artificial Sequence; identical to SEQ ID NO: 3267
  derived and/or modified CDS sequence (AUadapt) from InfluenzaA__AEO01038__HA

SEQ ID NO: 7390 - RNA, 1701 nt, Artificial Sequence; identical to SEQ ID NO: 96
  derived and/or modified CDS sequence (AUadapt) from InfluenzaA__AEO01039__HA

SEQ ID NO: 7391 - RNA, 1701 nt, Artificial Sequence
  derived and/or modified CDS sequence (AUadapt) from InfluenzaA__AEO01040__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaagaaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucacgauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 7392 - RNA, 1701 nt, Artificial Sequence; identical to SEQ ID NO: 116
  derived and/or modified CDS sequence (AUadapt) from InfluenzaA__AEO01041__HA

SEQ ID NO: 7393 - RNA, 1701 nt, Artificial Sequence; identical to SEQ ID NO: 3267
  derived and/or modified CDS sequence (AUadapt) from InfluenzaA__AEO01042__HA

SEQ ID NO: 7394 - RNA, 1701 nt, Artificial Sequence
  derived and/or modified CDS sequence (AUadapt) from InfluenzaA__AEO01043__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccaacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7395 - RNA, 1701 nt, Artificial Sequence; identical to SEQ ID NO: 116
  derived and/or modified CDS sequence (AUadapt) from InfluenzaA__AEO01044__HA

SEQ ID NO: 7396 - RNA, 1701 nt, Artificial Sequence
  derived and/or modified CDS sequence (AUadapt) from InfluenzaA__AEO01045__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaaccuggagugcgagagccucuccaccgccucguccuggagcuacaucguggagaccuccucguccgacaacggcacgugcuacccgggcgacuucaucgacuacgaggagcugcgggagcagcugagcuccgugucguccuucgagcgcuucgagaucuuccccaagaccagcuccuggcccaaccacgacucgaacaagggggucaccgccgccugcccccacgccggcgcgaaguccuucuacaagaaccucaucuggcuggugaagaaggggaacagcuacccgaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucucggacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacucgaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagucgacccgcaucuaccagauccuggcgaucuacuccaccgucgccagcucgcucgugcugguggucucccugggggccaucagcuucuggaugugcuccaacggcagccuccagugccggaucugcaucuga

SEQ ID NO: 7397 - RNA, 1701 nt, Artificial Sequence; identical to SEQ ID NO: 116
  derived and/or modified CDS sequence (AUadapt) from InfluenzaA__AEO01046__HA

SEQ ID NO: 7398 - RNA, 1701 nt, Artificial Sequence; identical to SEQ ID NO: 116
  derived and/or modified CDS sequence (AUadapt) from InfluenzaA__AEO01047__HA

SEQ ID NO: 7399 - RNA, 1701 nt, Artificial Sequence
  derived and/or modified CDS sequence (AUadapt) from InfluenzaA__AEO01048__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugcaagaucugcaucuga

SEQ ID NO: 7400 - RNA, 1701 nt, Artificial Sequence; identical to SEQ ID NO: 3812
  derived and/or modified CDS sequence (AUadapt) from InfluenzaA__AEO01049__HA

SEQ ID NO: 7401 - RNA, 1701 nt, Artificial Sequence; identical to SEQ ID NO: 116
  derived and/or modified CDS sequence (AUadapt) from InfluenzaA__AEO01050__HA

SEQ ID NO: 7402 - RNA, 1701 nt, Artificial Sequence; identical to SEQ ID NO: 3267
  derived and/or modified CDS sequence (AUadapt) from InfluenzaA__AEO01051__HA

SEQ ID NO: 7403 - RNA, 1701 nt, Artificial Sequence
  derived and/or modified CDS sequence (AUadapt) from InfluenzaA__AEO01052__HA
augaaggccaucaucgugguccugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 7404 - RNA, 1701 nt, Artificial Sequence; identical to SEQ ID NO: 3267
  derived and/or modified CDS sequence (AUadapt) from InfluenzaA__AEO01053__HA

SEQ ID NO: 7405 - RNA, 1701 nt, Artificial Sequence; identical to SEQ ID NO: 116
  derived and/or modified CDS sequence (AUadapt) from InfluenzaA__AEO01054__HA

SEQ ID NO: 7406 - RNA, 1701 nt, Artificial Sequence; identical to SEQ ID NO: 3726
  derived and/or modified CDS sequence (AUadapt) from InfluenzaA__AEO01055__HA

SEQ ID NO: 7407 - RNA, 1701 nt, Artificial Sequence; identical to SEQ ID NO: 3267
  derived and/or modified CDS sequence (AUadapt) from InfluenzaA__AEO01056__HA

SEQ ID NO: 7408 - RNA, 1701 nt, Artificial Sequence; identical to SEQ ID NO: 116
  derived and/or modified CDS sequence (AUadapt) from InfluenzaA__AEO01057__HA

SEQ ID NO: 7409 - RNA, 1701 nt, Artificial Sequence; identical to SEQ ID NO: 116
  derived and/or modified CDS sequence (AUadapt) from InfluenzaA__AEO01058__HA

SEQ ID NO: 7410 - RNA, 1701 nt, Artificial Sequence; identical to SEQ ID NO: 116
  derived and/or modified CDS sequence (AUadapt) from InfluenzaA__AEO01059__HA

SEQ ID NO: 7411 - RNA, 1701 nt, Artificial Sequence; identical to SEQ ID NO: 116
  derived and/or modified CDS sequence (AUadapt) from InfluenzaA__AEO01060__HA

SEQ ID NO: 7412 - RNA, 1701 nt, Artificial Sequence; identical to SEQ ID NO: 116
  derived and/or modified CDS sequence (AUadapt) from InfluenzaA__AEO01061__HA

SEQ ID NO: 7413 - RNA, 1701 nt, Artificial Sequence; identical to SEQ ID NO: 116
  derived and/or modified CDS sequence (AUadapt) from InfluenzaA__AEO01062__HA

SEQ ID NO: 7414 - RNA, 1701 nt, Artificial Sequence; identical to SEQ ID NO: 116
  derived and/or modified CDS sequence (AUadapt) from InfluenzaA__AEO01063__HA

SEQ ID NO: 7415 - RNA, 1701 nt, Artificial Sequence; identical to SEQ ID NO: 116
  derived and/or modified CDS sequence (AUadapt) from InfluenzaA__AEO01064__HA

SEQ ID NO: 7416 - RNA, 1701 nt, Artificial Sequence; identical to SEQ ID NO: 3156
  derived and/or modified CDS sequence (AUadapt) from InfluenzaA__AEO01065__HA

SEQ ID NO: 7417 - RNA, 1701 nt, Artificial Sequence; identical to SEQ ID NO: 3267
  derived and/or modified CDS sequence (AUadapt) from InfluenzaA__AEO01066__HA

SEQ ID NO: 7418 - RNA, 1701 nt, Artificial Sequence
  derived and/or modified CDS sequence (AUadapt) from InfluenzaA__AEO01067__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagauggccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7419 - RNA, 1701 nt, Artificial Sequence; identical to SEQ ID NO: 3267
  derived and/or modified CDS sequence (AUadapt) from InfluenzaA__AEO01068__HA

SEQ ID NO: 7420 - RNA, 1701 nt, Artificial Sequence; identical to SEQ ID NO: 116
  derived and/or modified CDS sequence (AUadapt) from InfluenzaA__AEO01069__HA

SEQ ID NO: 7421 - RNA, 1701 nt, Artificial Sequence; identical to SEQ ID NO: 3267
  derived and/or modified CDS sequence (AUadapt) from InfluenzaA__AEO01070__HA

SEQ ID NO: 7422 - RNA, 1701 nt, Artificial Sequence; identical to SEQ ID NO: 116
  derived and/or modified CDS sequence (AUadapt) from InfluenzaA__AEO01071__HA

SEQ ID NO: 7423 - RNA, 1701 nt, Artificial Sequence
  derived and/or modified CDS sequence (AUadapt) from InfluenzaA__AEO01073__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccgugaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 7424 - RNA, 1701 nt, Artificial Sequence; identical to SEQ ID NO: 3156
  derived and/or modified CDS sequence (AUadapt) from InfluenzaA__AEO01074__HA

SEQ ID NO: 7425 - RNA, 1701 nt, Artificial Sequence; identical to SEQ ID NO: 3267
  derived and/or modified CDS sequence (AUadapt) from InfluenzaA__AEO01075__HA

SEQ ID NO: 7426 - RNA, 1701 nt, Artificial Sequence; identical to SEQ ID NO: 3267
  derived and/or modified CDS sequence (AUadapt) from InfluenzaA__AEO01076__HA

SEQ ID NO: 7427 - RNA, 1701 nt, Artificial Sequence
  derived and/or modified CDS sequence (AUadapt) from InfluenzaA__AEO01077__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagaacgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7428 - RNA, 1701 nt, Artificial Sequence; identical to SEQ ID NO: 116
  derived and/or modified CDS sequence (AUadapt) from InfluenzaA__AEO01078__HA

SEQ ID NO: 7429 - RNA, 1701 nt, Artificial Sequence; identical to SEQ ID NO: 116
  derived and/or modified CDS sequence (AUadapt) from InfluenzaA__AEO01079__HA

SEQ ID NO: 7430 - RNA, 1701 nt, Artificial Sequence; identical to SEQ ID NO: 116
  derived and/or modified CDS sequence (AUadapt) from InfluenzaA__AEO01080__HA

SEQ ID NO: 7431 - RNA, 1701 nt, Artificial Sequence; identical to SEQ ID NO: 3267
  derived and/or modified CDS sequence (AUadapt) from InfluenzaA__AEO01081__HA

SEQ ID NO: 7432 - RNA, 1701 nt, Artificial Sequence; identical to SEQ ID NO: 116
  derived and/or modified CDS sequence (AUadapt) from InfluenzaA__AEO01082__HA

SEQ ID NO: 7433 - RNA, 1701 nt, Artificial Sequence; identical to SEQ ID NO: 116
  derived and/or modified CDS sequence (AUadapt) from InfluenzaA__AEO01083__HA

SEQ ID NO: 7434 - RNA, 1701 nt, Artificial Sequence; identical to SEQ ID NO: 116
  derived and/or modified CDS sequence (AUadapt) from InfluenzaA__AEO01084__HA

SEQ ID NO: 7435 - RNA, 1701 nt, Artificial Sequence; identical to SEQ ID NO: 3267
  derived and/or modified CDS sequence (AUadapt) from InfluenzaA__AEO01085__HA

SEQ ID NO: 7436 - RNA, 1701 nt, Artificial Sequence; identical to SEQ ID NO: 116
  derived and/or modified CDS sequence (AUadapt) from InfluenzaA__AEO01086__HA

SEQ ID NO: 7437 - RNA, 1701 nt, Artificial Sequence; identical to SEQ ID NO: 3267
  derived and/or modified CDS sequence (AUadapt) from InfluenzaA__AEO01087__HA

SEQ ID NO: 7438 - RNA, 1701 nt, Artificial Sequence; identical to SEQ ID NO: 96
  derived and/or modified CDS sequence (AUadapt) from InfluenzaA__AEO01088__HA

SEQ ID NO: 7439 - RNA, 1701 nt, Artificial Sequence; identical to SEQ ID NO: 3267
  derived and/or modified CDS sequence (AUadapt) from InfluenzaA__AEO01089__HA

SEQ ID NO: 7440 - RNA, 1701 nt, Artificial Sequence; identical to SEQ ID NO: 3267
  derived and/or modified CDS sequence (AUadapt) from InfluenzaA__AEO01090__HA

SEQ ID NO: 7441 - RNA, 1701 nt, Artificial Sequence; identical to SEQ ID NO: 3267
  derived and/or modified CDS sequence (AUadapt) from InfluenzaA__AEO01091__HA

SEQ ID NO: 7442 - RNA, 1701 nt, Artificial Sequence
  derived and/or modified CDS sequence (AUadapt) from InfluenzaA__AEO01092__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagcgcguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7443 - RNA, 1701 nt, Artificial Sequence; identical to SEQ ID NO: 116
  derived and/or modified CDS sequence (AUadapt) from InfluenzaA__AEO01093__HA

SEQ ID NO: 7444 - RNA, 1701 nt, Artificial Sequence; identical to SEQ ID NO: 116
  derived and/or modified CDS sequence (AUadapt) from InfluenzaA__AEO01094__HA

SEQ ID NO: 7445 - RNA, 1701 nt, Artificial Sequence; identical to SEQ ID NO: 6121
  derived and/or modified CDS sequence (AUadapt) from InfluenzaA__AEO01095__HA

SEQ ID NO: 7446 - RNA, 1701 nt, Artificial Sequence; identical to SEQ ID NO: 3267
  derived and/or modified CDS sequence (AUadapt) from InfluenzaA__AEO01096__HA

SEQ ID NO: 7447 - RNA, 1701 nt, Artificial Sequence; identical to SEQ ID NO: 3267
  derived and/or modified CDS sequence (AUadapt) from InfluenzaA__AEO01097__HA

SEQ ID NO: 7448 - RNA, 1701 nt, Artificial Sequence; identical to SEQ ID NO: 3267
  derived and/or modified CDS sequence (AUadapt) from InfluenzaA__AEO01098__HA

SEQ ID NO: 7449 - RNA, 1701 nt, Artificial Sequence; identical to SEQ ID NO: 116
  derived and/or modified CDS sequence (AUadapt) from InfluenzaA__AEO01099__HA

SEQ ID NO: 7450 - RNA, 1701 nt, Artificial Sequence; identical to SEQ ID NO: 3156
  derived and/or modified CDS sequence (AUadapt) from InfluenzaA__AEO01100__HA

SEQ ID NO: 7451 - RNA, 1701 nt, Artificial Sequence; identical to SEQ ID NO: 116
  derived and/or modified CDS sequence (AUadapt) from InfluenzaA__AEO01101__HA

SEQ ID NO: 7452 - RNA, 1701 nt, Artificial Sequence; identical to SEQ ID NO: 116
  derived and/or modified CDS sequence (AUadapt) from InfluenzaA__AEO01102__HA

SEQ ID NO: 7453 - RNA, 1701 nt, Artificial Sequence; identical to SEQ ID NO: 3267
  derived and/or modified CDS sequence (AUadapt) from InfluenzaA__AEO01103__HA

SEQ ID NO: 7454 - RNA, 1701 nt, Artificial Sequence; identical to SEQ ID NO: 3267
  derived and/or modified CDS sequence (AUadapt) from InfluenzaA__AEO01104__HA

SEQ ID NO: 7455 - RNA, 1701 nt, Artificial Sequence
  derived and/or modified CDS sequence (AUadapt) from InfluenzaA__AEO01105__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucguccaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 7456 - RNA, 1701 nt, Artificial Sequence; identical to SEQ ID NO: 3267
  derived and/or modified CDS sequence (AUadapt) from InfluenzaA__AEO01106__HA

SEQ ID NO: 7457 - RNA, 1701 nt, Artificial Sequence; identical to SEQ ID NO: 116
  derived and/or modified CDS sequence (AUadapt) from InfluenzaA__AEO01107__HA

SEQ ID NO: 7458 - RNA, 1701 nt, Artificial Sequence; identical to SEQ ID NO: 116
  derived and/or modified CDS sequence (AUadapt) from InfluenzaA__AEO01108__HA

SEQ ID NO: 7459 - RNA, 1701 nt, Artificial Sequence; identical to SEQ ID NO: 116
  derived and/or modified CDS sequence (AUadapt) from InfluenzaA__AEO01109__HA

SEQ ID NO: 7460 - RNA, 1701 nt, Artificial Sequence; identical to SEQ ID NO: 116
  derived and/or modified CDS sequence (AUadapt) from InfluenzaA__AEO01110__HA

SEQ ID NO: 7461 - RNA, 1701 nt, Artificial Sequence; identical to SEQ ID NO: 116
  derived and/or modified CDS sequence (AUadapt) from InfluenzaA__AEO01111__HA

SEQ ID NO: 7462 - RNA, 1701 nt, Artificial Sequence; identical to SEQ ID NO: 116
  derived and/or modified CDS sequence (AUadapt) from InfluenzaA__AEO01112__HA

SEQ ID NO: 7463 - RNA, 1701 nt, Artificial Sequence
  derived and/or modified CDS sequence (AUadapt) from InfluenzaA__AEO01113__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugccugcacgccggcgcgaaguccuucuacaagaaccucaucuggcuggugaagaaggggaacagcuacccgaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucucggacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacucgaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagucgacccgcaucuaccagauccuggcgaucuacuccaccgucgccagcucgcucgugcugguggucucccugggggccaucagcuucuggaugugcuccaacggcagccuccagugccggaucugcaucuga

SEQ ID NO: 7464 - RNA, 1701 nt, Artificial Sequence; identical to SEQ ID NO: 3156
  derived and/or modified CDS sequence (AUadapt) from InfluenzaA__AEO01114__HA

SEQ ID NO: 7465 - RNA, 1701 nt, Artificial Sequence
  derived and/or modified CDS sequence (AUadapt) from InfluenzaA__AEO01115__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugccugcacgccggcgcgaaguccuucuacaagaaccucaucuggcuggugaagaaggggaacagcuacccgaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucucggacacgcccgugcacgacugcaacacgaccugccagacccccaagggcgccaucaacaccucccugccguuccacaacauccaccccaucaccaucgggaagugccccaaguacgucaagagcaccaagcuccggcuggcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacucgaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagucgacccgcaucuaccagauccuggcgaucuacuccaccgucgccagcucgcucgugcugguggucucccugggggccaucagcuucuggaugugcuccaacggcagccuccagugccggaucugcaucuga

SEQ ID NO: 7466 - RNA, 1701 nt, Artificial Sequence; identical to SEQ ID NO: 116
  derived and/or modified CDS sequence (AUadapt) from InfluenzaA__AEO01116__HA

SEQ ID NO: 7467 - RNA, 1701 nt, Artificial Sequence; identical to SEQ ID NO: 116
  derived and/or modified CDS sequence (AUadapt) from InfluenzaA__AEO01117__HA

SEQ ID NO: 7468 - RNA, 1701 nt, Artificial Sequence; identical to SEQ ID NO: 3780
  derived and/or modified CDS sequence (AUadapt) from InfluenzaA__AEO01118__HA

SEQ ID NO: 7469 - RNA, 1701 nt, Artificial Sequence; identical to SEQ ID NO: 116
  derived and/or modified CDS sequence (AUadapt) from InfluenzaA__AEO01119__HA

SEQ ID NO: 7470 - RNA, 1701 nt, Artificial Sequence
  derived and/or modified CDS sequence (AUadapt) from InfluenzaA__AEO01120__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacgucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7471 - RNA, 1701 nt, Artificial Sequence; identical to SEQ ID NO: 116
  derived and/or modified CDS sequence (AUadapt) from InfluenzaA__AEO01121__HA

SEQ ID NO: 7472 - RNA, 1701 nt, Artificial Sequence; identical to SEQ ID NO: 3267
  derived and/or modified CDS sequence (AUadapt) from InfluenzaA__AEO01122__HA

SEQ ID NO: 7473 - RNA, 1701 nt, Artificial Sequence; identical to SEQ ID NO: 116
  derived and/or modified CDS sequence (AUadapt) from InfluenzaA__AEO01123__HA

SEQ ID NO: 7474 - RNA, 1701 nt, Artificial Sequence; identical to SEQ ID NO: 116
  derived and/or modified CDS sequence (AUadapt) from InfluenzaA__AEO01124__HA

SEQ ID NO: 7475 - RNA, 1701 nt, Artificial Sequence; identical to SEQ ID NO: 3267
  derived and/or modified CDS sequence (AUadapt) from InfluenzaA__AEO01125__HA

SEQ ID NO: 7476 - RNA, 1701 nt, Artificial Sequence
  derived and/or modified CDS sequence (AUadapt) from InfluenzaA__AEO01126__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcacguccgccgaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7477 - RNA, 1701 nt, Artificial Sequence; identical to SEQ ID NO: 116
  derived and/or modified CDS sequence (AUadapt) from InfluenzaA__AEO01127__HA

SEQ ID NO: 7478 - RNA, 1701 nt, Artificial Sequence; identical to SEQ ID NO: 116
  derived and/or modified CDS sequence (AUadapt) from InfluenzaA__AEO01128__HA

SEQ ID NO: 7479 - RNA, 1701 nt, Artificial Sequence; identical to SEQ ID NO: 3267
  derived and/or modified CDS sequence (AUadapt) from InfluenzaA__AEO01129__HA

SEQ ID NO: 7480 - RNA, 1701 nt, Artificial Sequence; identical to SEQ ID NO: 116
  derived and/or modified CDS sequence (AUadapt) from InfluenzaA__AEO01130__HA

SEQ ID NO: 7481 - RNA, 1701 nt, Artificial Sequence; identical to SEQ ID NO: 3267
  derived and/or modified CDS sequence (AUadapt) from InfluenzaA__AEO01131__HA

SEQ ID NO: 7482 - RNA, 1701 nt, Artificial Sequence; identical to SEQ ID NO: 116
  derived and/or modified CDS sequence (AUadapt) from InfluenzaA__AEO01132__HA

SEQ ID NO: 7483 - RNA, 1701 nt, Artificial Sequence
  derived and/or modified CDS sequence (AUadapt) from InfluenzaA__AEO01133__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccaccaugaucuaccagauccucgcgaucuacagcaccgucgccucgucccuggugcugguggucagccucggggccaucuccuucuggaugugcagcaacggcucccugcagugccgcaucugcaucuga

SEQ ID NO: 7484 - RNA, 1701 nt, Artificial Sequence; identical to SEQ ID NO: 3267
  derived and/or modified CDS sequence (AUadapt) from InfluenzaA__AEO01134__HA

SEQ ID NO: 7485 - RNA, 1701 nt, Artificial Sequence; identical to SEQ ID NO: 3267
  derived and/or modified CDS sequence (AUadapt) from InfluenzaA__AEO01135__HA

SEQ ID NO: 7486 - RNA, 1701 nt, Artificial Sequence; identical to SEQ ID NO: 116
  derived and/or modified CDS sequence (AUadapt) from InfluenzaA__AEO01136__HA

SEQ ID NO: 7487 - RNA, 1701 nt, Artificial Sequence; identical to SEQ ID NO: 3361
  derived and/or modified CDS sequence (AUadapt) from InfluenzaA__AEO01137__HA

SEQ ID NO: 7488 - RNA, 1701 nt, Artificial Sequence; identical to SEQ ID NO: 3361
  derived and/or modified CDS sequence (AUadapt) from InfluenzaA__AEO01138__HA

SEQ ID NO: 7489 - RNA, 1701 nt, Artificial Sequence; identical to SEQ ID NO: 116
  derived and/or modified CDS sequence (AUadapt) from InfluenzaA__AEO01139__HA

SEQ ID NO: 7490 - RNA, 1701 nt, Artificial Sequence; identical to SEQ ID NO: 116
  derived and/or modified CDS sequence (AUadapt) from InfluenzaA__AEO01140__HA

SEQ ID NO: 7491 - RNA, 1701 nt, Artificial Sequence; identical to SEQ ID NO: 116
  derived and/or modified CDS sequence (AUadapt) from InfluenzaA__AEO01141__HA

SEQ ID NO: 7492 - RNA, 1701 nt, Artificial Sequence; identical to SEQ ID NO: 116
  derived and/or modified CDS sequence (AUadapt) from InfluenzaA__AEO01142__HA

SEQ ID NO: 7493 - RNA, 1701 nt, Artificial Sequence
  derived and/or modified CDS sequence (AUadapt) from InfluenzaA__AEO01144__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccaucagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgcgaagggguucuacaagaaccugaucuggcucgugaagaagggcaacagcuaccccaagcuguccaagucguacaucaacgacaaggggaaggaggugcugguccucuggggcauccaccaccccuccaccagcgccgaccagcagucgcuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgucccuggugcucguggucagccugggcgccaucucguucuggaugugcuccaacggcagccugcagugccggaucugcaucuga

SEQ ID NO: 7494 - RNA, 1701 nt, Artificial Sequence; identical to SEQ ID NO: 96
  derived and/or modified CDS sequence (AUadapt) from InfluenzaA__AEO01145__HA

SEQ ID NO: 7495 - RNA, 1701 nt, Artificial Sequence
  derived and/or modified CDS sequence (AUadapt) from InfluenzaA__AEO01146__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaaccccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7496 - RNA, 1701 nt, Artificial Sequence; identical to SEQ ID NO: 116
  derived and/or modified CDS sequence (AUadapt) from InfluenzaA__AEO01147__HA

SEQ ID NO: 7497 - RNA, 1701 nt, Artificial Sequence; identical to SEQ ID NO: 3267
  derived and/or modified CDS sequence (AUadapt) from InfluenzaA__AEO01148__HA

SEQ ID NO: 7498 - RNA, 1701 nt, Artificial Sequence; identical to SEQ ID NO: 3267
  derived and/or modified CDS sequence (AUadapt) from InfluenzaA__AEO01149__HA

SEQ ID NO: 7499 - RNA, 1701 nt, Artificial Sequence; identical to SEQ ID NO: 6121
  derived and/or modified CDS sequence (AUadapt) from InfluenzaA__AEO01150__HA

SEQ ID NO: 7500 - RNA, 1701 nt, Artificial Sequence; identical to SEQ ID NO: 116
  derived and/or modified CDS sequence (AUadapt) from InfluenzaA__AEO01151__HA

SEQ ID NO: 7501 - RNA, 1701 nt, Artificial Sequence
  derived and/or modified CDS sequence (AUadapt) from InfluenzaA__AEO01152__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcggggccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 7502 - RNA, 1701 nt, Artificial Sequence
  derived and/or modified CDS sequence (AUadapt) from InfluenzaA__AEO01153__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacaacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcaacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7503 - RNA, 1701 nt, Artificial Sequence; identical to SEQ ID NO: 116
  derived and/or modified CDS sequence (AUadapt) from InfluenzaA__AEO01154__HA

SEQ ID NO: 7504 - RNA, 1701 nt, Artificial Sequence; identical to SEQ ID NO: 3267
  derived and/or modified CDS sequence (AUadapt) from InfluenzaA__AEO01155__HA

SEQ ID NO: 7505 - RNA, 1701 nt, Artificial Sequence; identical to SEQ ID NO: 3267
  derived and/or modified CDS sequence (AUadapt) from InfluenzaA__AEO01156__HA

SEQ ID NO: 7506 - RNA, 1701 nt, Artificial Sequence; identical to SEQ ID NO: 116
  derived and/or modified CDS sequence (AUadapt) from InfluenzaA__AEO01157__HA

SEQ ID NO: 7507 - RNA, 1701 nt, Artificial Sequence; identical to SEQ ID NO: 116
  derived and/or modified CDS sequence (AUadapt) from InfluenzaA__AEO01158__HA

SEQ ID NO: 7508 - RNA, 1701 nt, Artificial Sequence; identical to SEQ ID NO: 116
  derived and/or modified CDS sequence (AUadapt) from InfluenzaA__AEO01159__HA

SEQ ID NO: 7509 - RNA, 1701 nt, Artificial Sequence
  derived and/or modified CDS sequence (AUadapt) from InfluenzaA__AEO01160__HA
augaaggccauccugguggcccuccuguacaccuucgcgaccgccaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggagcaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 7510 - RNA, 1701 nt, Artificial Sequence; identical to SEQ ID NO: 116
  derived and/or modified CDS sequence (AUadapt) from InfluenzaA__AEO01161__HA

SEQ ID NO: 7511 - RNA, 1701 nt, Artificial Sequence; identical to SEQ ID NO: 3267
  derived and/or modified CDS sequence (AUadapt) from InfluenzaA__AEO01162__HA

SEQ ID NO: 7512 - RNA, 1701 nt, Artificial Sequence; identical to SEQ ID NO: 3267
  derived and/or modified CDS sequence (AUadapt) from InfluenzaA__AEO01163__HA

SEQ ID NO: 7513 - RNA, 1701 nt, Artificial Sequence; identical to SEQ ID NO: 3267
  derived and/or modified CDS sequence (AUadapt) from InfluenzaA__AEO01164__HA

SEQ ID NO: 7514 - RNA, 1701 nt, Artificial Sequence
  derived and/or modified CDS sequence (AUadapt) from InfluenzaA__AEO01165__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaaguucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacucgaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgcgaucuacuccaccgucgccagcucgcuggugcugguggucucccucggggccaucagcuucuggaugugcuccaacggcagccugcagugccggaucugcaucuga

SEQ ID NO: 7515 - RNA, 1701 nt, Artificial Sequence; identical to SEQ ID NO: 3267
  derived and/or modified CDS sequence (AUadapt) from InfluenzaA__AEO01166__HA

SEQ ID NO: 7516 - RNA, 1701 nt, Artificial Sequence
  derived and/or modified CDS sequence (AUadapt) from InfluenzaA__AEO01167__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacguccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 7517 - RNA, 1701 nt, Artificial Sequence; identical to SEQ ID NO: 116
  derived and/or modified CDS sequence (AUadapt) from InfluenzaA__AEO01168__HA

SEQ ID NO: 7518 - RNA, 1701 nt, Artificial Sequence; identical to SEQ ID NO: 3267
  derived and/or modified CDS sequence (AUadapt) from InfluenzaA__AEO01169__HA

SEQ ID NO: 7519 - RNA, 1701 nt, Artificial Sequence; identical to SEQ ID NO: 3267
  derived and/or modified CDS sequence (AUadapt) from InfluenzaA__AEO01170__HA

SEQ ID NO: 7520 - RNA, 1701 nt, Artificial Sequence; identical to SEQ ID NO: 3267
  derived and/or modified CDS sequence (AUadapt) from InfluenzaA__AEO01171__HA

SEQ ID NO: 7521 - RNA, 1701 nt, Artificial Sequence; identical to SEQ ID NO: 116
  derived and/or modified CDS sequence (AUadapt) from InfluenzaA__AEO01172__HA

SEQ ID NO: 7522 - RNA, 1701 nt, Artificial Sequence
  derived and/or modified CDS sequence (AUadapt) from InfluenzaA__AEO01173__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccgggggcaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 7523 - RNA, 1701 nt, Artificial Sequence
  derived and/or modified CDS sequence (AUadapt) from InfluenzaA__AEO01174__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggagcaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 7524 - RNA, 1701 nt, Artificial Sequence; identical to SEQ ID NO: 116
  derived and/or modified CDS sequence (AUadapt) from InfluenzaA__AEO01176__HA

SEQ ID NO: 7525 - RNA, 1701 nt, Artificial Sequence; identical to SEQ ID NO: 116
  derived and/or modified CDS sequence (AUadapt) from InfluenzaA__AEO01177__HA

SEQ ID NO: 7526 - RNA, 1701 nt, Artificial Sequence; identical to SEQ ID NO: 3267
  derived and/or modified CDS sequence (AUadapt) from InfluenzaA__AEO01179__HA

SEQ ID NO: 7527 - RNA, 1701 nt, Artificial Sequence; identical to SEQ ID NO: 3267
  derived and/or modified CDS sequence (AUadapt) from InfluenzaA__AEO01180__HA

SEQ ID NO: 7528 - RNA, 1701 nt, Artificial Sequence; identical to SEQ ID NO: 3267
  derived and/or modified CDS sequence (AUadapt) from InfluenzaA__AEO01181__HA

SEQ ID NO: 7529 - RNA, 1701 nt, Artificial Sequence; identical to SEQ ID NO: 3267
  derived and/or modified CDS sequence (AUadapt) from InfluenzaA__AEO01182__HA

SEQ ID NO: 7530 - RNA, 1701 nt, Artificial Sequence; identical to SEQ ID NO: 116
  derived and/or modified CDS sequence (AUadapt) from InfluenzaA__AEO01183__HA

SEQ ID NO: 7531 - RNA, 1701 nt, Artificial Sequence; identical to SEQ ID NO: 3267
  derived and/or modified CDS sequence (AUadapt) from InfluenzaA__AEO01184__HA

SEQ ID NO: 7532 - RNA, 1701 nt, Artificial Sequence; identical to SEQ ID NO: 116
  derived and/or modified CDS sequence (AUadapt) from InfluenzaA__AEO01185__HA

SEQ ID NO: 7533 - RNA, 1701 nt, Artificial Sequence; identical to SEQ ID NO: 116
  derived and/or modified CDS sequence (AUadapt) from InfluenzaA__AEO01186__HA

SEQ ID NO: 7534 - RNA, 1701 nt, Artificial Sequence; identical to SEQ ID NO: 116
  derived and/or modified CDS sequence (AUadapt) from InfluenzaA__AEO01187__HA

SEQ ID NO: 7535 - RNA, 1701 nt, Artificial Sequence; identical to SEQ ID NO: 116
  derived and/or modified CDS sequence (AUadapt) from InfluenzaA__AEO01188__HA

SEQ ID NO: 7536 - RNA, 1701 nt, Artificial Sequence; identical to SEQ ID NO: 116
  derived and/or modified CDS sequence (AUadapt) from InfluenzaA__AEO01189__HA

SEQ ID NO: 7537 - RNA, 1701 nt, Artificial Sequence; identical to SEQ ID NO: 116
  derived and/or modified CDS sequence (AUadapt) from InfluenzaA__AEO01191__HA

SEQ ID NO: 7538 - RNA, 1701 nt, Artificial Sequence; identical to SEQ ID NO: 116
  derived and/or modified CDS sequence (AUadapt) from InfluenzaA__AEO01192__HA

SEQ ID NO: 7539 - RNA, 1701 nt, Artificial Sequence; identical to SEQ ID NO: 4228
  derived and/or modified CDS sequence (AUadapt) from InfluenzaA__AEO01193__HA

SEQ ID NO: 7540 - RNA, 1701 nt, Artificial Sequence; identical to SEQ ID NO: 3267
  derived and/or modified CDS sequence (AUadapt) from InfluenzaA__AEO01194__HA

SEQ ID NO: 7541 - RNA, 1701 nt, Artificial Sequence; identical to SEQ ID NO: 3267
  derived and/or modified CDS sequence (AUadapt) from InfluenzaA__AEO01195__HA

SEQ ID NO: 7542 - RNA, 1701 nt, Artificial Sequence; identical to SEQ ID NO: 116
  derived and/or modified CDS sequence (AUadapt) from InfluenzaA__AEO01196__HA

SEQ ID NO: 7543 - RNA, 1701 nt, Artificial Sequence; identical to SEQ ID NO: 116
  derived and/or modified CDS sequence (AUadapt) from InfluenzaA__AEO01197__HA

SEQ ID NO: 7544 - RNA, 1701 nt, Artificial Sequence; identical to SEQ ID NO: 3267
  derived and/or modified CDS sequence (AUadapt) from InfluenzaA__AEO01198__HA

SEQ ID NO: 7545 - RNA, 1701 nt, Artificial Sequence; identical to SEQ ID NO: 3780
  derived and/or modified CDS sequence (AUadapt) from InfluenzaA__AEO01200__HA

SEQ ID NO: 7546 - RNA, 1701 nt, Artificial Sequence
  derived and/or modified CDS sequence (AUadapt) from InfluenzaA__AEO01201__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggagaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7547 - RNA, 1701 nt, Artificial Sequence; identical to SEQ ID NO: 116
  derived and/or modified CDS sequence (AUadapt) from InfluenzaA__AEO01202__HA

SEQ ID NO: 7548 - RNA, 1701 nt, Artificial Sequence; identical to SEQ ID NO: 4550
  derived and/or modified CDS sequence (AUadapt) from InfluenzaA__AEO01203__HA

SEQ ID NO: 7549 - RNA, 1701 nt, Artificial Sequence; identical to SEQ ID NO: 116
  derived and/or modified CDS sequence (AUadapt) from InfluenzaA__AEO01204__HA

SEQ ID NO: 7550 - RNA, 1701 nt, Artificial Sequence; identical to SEQ ID NO: 116
  derived and/or modified CDS sequence (AUadapt) from InfluenzaA__AEO01205__HA

SEQ ID NO: 7551 - RNA, 1701 nt, Artificial Sequence; identical to SEQ ID NO: 116
  derived and/or modified CDS sequence (AUadapt) from InfluenzaA__AEO01206__HA

SEQ ID NO: 7552 - RNA, 1701 nt, Artificial Sequence; identical to SEQ ID NO: 116
  derived and/or modified CDS sequence (AUadapt) from InfluenzaA__AEO01207__HA

SEQ ID NO: 7553 - RNA, 1701 nt, Artificial Sequence; identical to SEQ ID NO: 116
  derived and/or modified CDS sequence (AUadapt) from InfluenzaA__AEO01208__HA

SEQ ID NO: 7554 - RNA, 1701 nt, Artificial Sequence; identical to SEQ ID NO: 3267
  derived and/or modified CDS sequence (AUadapt) from InfluenzaA__AEO01209__HA

SEQ ID NO: 7555 - RNA, 1701 nt, Artificial Sequence; identical to SEQ ID NO: 116
  derived and/or modified CDS sequence (AUadapt) from InfluenzaA__AEO01210__HA

SEQ ID NO: 7556 - RNA, 1701 nt, Artificial Sequence; identical to SEQ ID NO: 3267
  derived and/or modified CDS sequence (AUadapt) from InfluenzaA__AEO01211__HA

SEQ ID NO: 7557 - RNA, 1701 nt, Artificial Sequence; identical to SEQ ID NO: 116
  derived and/or modified CDS sequence (AUadapt) from InfluenzaA__AEO01212__HA

SEQ ID NO: 7558 - RNA, 1701 nt, Artificial Sequence; identical to SEQ ID NO: 116
  derived and/or modified CDS sequence (AUadapt) from InfluenzaA__AEO01213__HA

SEQ ID NO: 7559 - RNA, 1701 nt, Artificial Sequence
  derived and/or modified CDS sequence (AUadapt) from InfluenzaA__AEO01214__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 7560 - RNA, 1701 nt, Artificial Sequence; identical to SEQ ID NO: 3267
  derived and/or modified CDS sequence (AUadapt) from InfluenzaA__AEO01215__HA

SEQ ID NO: 7561 - RNA, 1701 nt, Artificial Sequence
  derived and/or modified CDS sequence (AUadapt) from InfluenzaA__AEO01216__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcgucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 7562 - RNA, 1701 nt, Artificial Sequence; identical to SEQ ID NO: 3267
  derived and/or modified CDS sequence (AUadapt) from InfluenzaA__AEO01217__HA

SEQ ID NO: 7563 - RNA, 1701 nt, Artificial Sequence; identical to SEQ ID NO: 3267
  derived and/or modified CDS sequence (AUadapt) from InfluenzaA__AEO01218__HA

SEQ ID NO: 7564 - RNA, 1701 nt, Artificial Sequence; identical to SEQ ID NO: 3267
  derived and/or modified CDS sequence (AUadapt) from InfluenzaA__AEO01219__HA

SEQ ID NO: 7565 - RNA, 1701 nt, Artificial Sequence; identical to SEQ ID NO: 3005
  derived and/or modified CDS sequence (AUadapt) from InfluenzaA__AEO01220__HA

SEQ ID NO: 7566 - RNA, 1701 nt, Artificial Sequence; identical to SEQ ID NO: 116
  derived and/or modified CDS sequence (AUadapt) from InfluenzaA__AEO01221__HA

SEQ ID NO: 7567 - RNA, 1701 nt, Artificial Sequence; identical to SEQ ID NO: 116
  derived and/or modified CDS sequence (AUadapt) from InfluenzaA__AEO01222__HA

SEQ ID NO: 7568 - RNA, 1701 nt, Artificial Sequence; identical to SEQ ID NO: 3267
  derived and/or modified CDS sequence (AUadapt) from InfluenzaA__AEO01223__HA

SEQ ID NO: 7569 - RNA, 1701 nt, Artificial Sequence
  derived and/or modified CDS sequence (AUadapt) from InfluenzaA__AEO01224__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccacggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7570 - RNA, 1701 nt, Artificial Sequence
  derived and/or modified CDS sequence (AUadapt) from InfluenzaA__AEO01225__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggaccgugguggagcccggggacaagaucaccuucgaggcgaccggcaaccuggucgugccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcuggagagcacccgcaucuaccagauccucgcgaucuacuccaccguggccucgagccuggugcuggucgugucccucggggccaucucguucuggaugugcuccaacggcagccugcagugccggaucugcaucuga

SEQ ID NO: 7571 - RNA, 1701 nt, Artificial Sequence
  derived and/or modified CDS sequence (AUadapt) from InfluenzaA__AEO01226__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgacggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7572 - RNA, 1701 nt, Artificial Sequence; identical to SEQ ID NO: 5081
  derived and/or modified CDS sequence (AUadapt) from InfluenzaA__AEO01227__HA

SEQ ID NO: 7573 - RNA, 1701 nt, Artificial Sequence; identical to SEQ ID NO: 116
  derived and/or modified CDS sequence (AUadapt) from InfluenzaA__AEO01228__HA

SEQ ID NO: 7574 - RNA, 1701 nt, Artificial Sequence; identical to SEQ ID NO: 116
  derived and/or modified CDS sequence (AUadapt) from InfluenzaA__AEO01229__HA

SEQ ID NO: 7575 - RNA, 1701 nt, Artificial Sequence
  derived and/or modified CDS sequence (AUadapt) from InfluenzaA__AEO01230__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccaaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7576 - RNA, 1701 nt, Artificial Sequence; identical to SEQ ID NO: 116
  derived and/or modified CDS sequence (AUadapt) from InfluenzaA__AEO01231__HA

SEQ ID NO: 7577 - RNA, 1701 nt, Artificial Sequence; identical to SEQ ID NO: 3267
  derived and/or modified CDS sequence (AUadapt) from InfluenzaA__AEO01232__HA

SEQ ID NO: 7578 - RNA, 1701 nt, Artificial Sequence; identical to SEQ ID NO: 116
  derived and/or modified CDS sequence (AUadapt) from InfluenzaA__AEO01233__HA

SEQ ID NO: 7579 - RNA, 1701 nt, Artificial Sequence; identical to SEQ ID NO: 116
  derived and/or modified CDS sequence (AUadapt) from InfluenzaA__AEO01234__HA

SEQ ID NO: 7580 - RNA, 1701 nt, Artificial Sequence; identical to SEQ ID NO: 116
  derived and/or modified CDS sequence (AUadapt) from InfluenzaA__AEO01235__HA

SEQ ID NO: 7581 - RNA, 1701 nt, Artificial Sequence; identical to SEQ ID NO: 6786
  derived and/or modified CDS sequence (AUadapt) from InfluenzaA__AEO01236__HA

SEQ ID NO: 7582 - RNA, 1701 nt, Artificial Sequence; identical to SEQ ID NO: 116
  derived and/or modified CDS sequence (AUadapt) from InfluenzaA__AEO01237__HA

SEQ ID NO: 7583 - RNA, 1701 nt, Artificial Sequence; identical to SEQ ID NO: 116
  derived and/or modified CDS sequence (AUadapt) from InfluenzaA__AEO01238__HA

SEQ ID NO: 7584 - RNA, 1701 nt, Artificial Sequence; identical to SEQ ID NO: 116
  derived and/or modified CDS sequence (AUadapt) from InfluenzaA__AEO01240__HA

SEQ ID NO: 7585 - RNA, 1701 nt, Artificial Sequence; identical to SEQ ID NO: 3267
  derived and/or modified CDS sequence (AUadapt) from InfluenzaA__AEO01241__HA

SEQ ID NO: 7586 - RNA, 1701 nt, Artificial Sequence; identical to SEQ ID NO: 116
  derived and/or modified CDS sequence (AUadapt) from InfluenzaA__AEO01242__HA

SEQ ID NO: 7587 - RNA, 1701 nt, Artificial Sequence
  derived and/or modified CDS sequence (AUadapt) from InfluenzaA__AEO01244__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccauccggccgaagguccgcggccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 7588 - RNA, 1701 nt, Artificial Sequence; identical to SEQ ID NO: 116
  derived and/or modified CDS sequence (AUadapt) from InfluenzaA__AEO01245__HA

SEQ ID NO: 7589 - RNA, 1701 nt, Artificial Sequence
  derived and/or modified CDS sequence (AUadapt) from InfluenzaA__AEO01247__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcauccugaucagcgacacgcccgugcacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgagccucgugcugguggucucccugggggccaucucguucuggaugugcuccaacggcagccuccagugccggaucugcaucuga

SEQ ID NO: 7590 - RNA, 1701 nt, Artificial Sequence; identical to SEQ ID NO: 116
  derived and/or modified CDS sequence (AUadapt) from InfluenzaA__AEO01248__HA

SEQ ID NO: 7591 - RNA, 1701 nt, Artificial Sequence; identical to SEQ ID NO: 116
  derived and/or modified CDS sequence (AUadapt) from InfluenzaA__AEO01249__HA

SEQ ID NO: 7592 - RNA, 1701 nt, Artificial Sequence
  derived and/or modified CDS sequence (AUadapt) from InfluenzaA__AEO01250__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgaggacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7593 - RNA, 1701 nt, Artificial Sequence; identical to SEQ ID NO: 4511
  derived and/or modified CDS sequence (AUadapt) from InfluenzaA__AEO01251__HA

SEQ ID NO: 7594 - RNA, 1701 nt, Artificial Sequence; identical to SEQ ID NO: 116
  derived and/or modified CDS sequence (AUadapt) from InfluenzaA__AEO01252__HA

SEQ ID NO: 7595 - RNA, 1701 nt, Artificial Sequence; identical to SEQ ID NO: 116
  derived and/or modified CDS sequence (AUadapt) from InfluenzaA__AEO01253__HA

SEQ ID NO: 7596 - RNA, 1701 nt, Artificial Sequence
  derived and/or modified CDS sequence (AUadapt) from InfluenzaA__AEO01254__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacaacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7597 - RNA, 1701 nt, Artificial Sequence; identical to SEQ ID NO: 3361
  derived and/or modified CDS sequence (AUadapt) from InfluenzaA__AEO01256__HA

SEQ ID NO: 7598 - RNA, 1701 nt, Artificial Sequence; identical to SEQ ID NO: 6333
  derived and/or modified CDS sequence (AUadapt) from InfluenzaA__AEO01257__HA

SEQ ID NO: 7599 - RNA, 1701 nt, Artificial Sequence; identical to SEQ ID NO: 116
  derived and/or modified CDS sequence (AUadapt) from InfluenzaA__AEO01258__HA

SEQ ID NO: 7600 - RNA, 1701 nt, Artificial Sequence; identical to SEQ ID NO: 7596
  derived and/or modified CDS sequence (AUadapt) from InfluenzaA__AEO01259__HA

SEQ ID NO: 7601 - RNA, 1701 nt, Artificial Sequence; identical to SEQ ID NO: 5469
  derived and/or modified CDS sequence (AUadapt) from InfluenzaA__AEO01260__HA

SEQ ID NO: 7602 - RNA, 1701 nt, Artificial Sequence
  derived and/or modified CDS sequence (AUadapt) from InfluenzaA__AEO01261__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcaccgggaucuaccagauccucgcgaucuacuccaccgucgccucgagccuggugcugguggucucccucggcgccaucucguucuggaugugcuccaacggcagccugcagugccgcaucugcaucuga

SEQ ID NO: 7603 - RNA, 1701 nt, Artificial Sequence; identical to SEQ ID NO: 116
  derived and/or modified CDS sequence (AUadapt) from InfluenzaA__AEO01262__HA

SEQ ID NO: 7604 - RNA, 1701 nt, Artificial Sequence; identical to SEQ ID NO: 4596
  derived and/or modified CDS sequence (AUadapt) from InfluenzaA__AEO01263__HA

SEQ ID NO: 7605 - RNA, 1701 nt, Artificial Sequence; identical to SEQ ID NO: 3267
  derived and/or modified CDS sequence (AUadapt) from InfluenzaA__AEO01264__HA

SEQ ID NO: 7606 - RNA, 1701 nt, Artificial Sequence; identical to SEQ ID NO: 116
  derived and/or modified CDS sequence (AUadapt) from InfluenzaA__AEO01265__HA

SEQ ID NO: 7607 - RNA, 1701 nt, Artificial Sequence
  derived and/or modified CDS sequence (AUadapt) from InfluenzaA__AEO01266__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacgcccccgugcacgacugcaacacgaccugccagaccccgaagggggcgaucaacaccucccugcccuuccagaacauccaccccaucacgaucggcaagugccccaaguacgucaagucgaccaagcugcggcucgccaccgggcugcgcaacgugccguccauccagagccggggccuguucggggccaucgccggcuucaucgagggcggguggaccggcaugguggacgggugguacggcuaccaccaccagaacgagcagggguccggcuacgccgcggaccucaagucgacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggcgaagcugaaccgggaggagaucgacggggugaagcucgagagcacccgcaucuaccagauccuggccaucuacuccaccgucgccucgagccuggugcucguggucucccugggcgccaucucguucuggaugugcuccaacggcagccugcagugccggaucugcaucuga

SEQ ID NO: 7608 - RNA, 1701 nt, Artificial Sequence; identical to SEQ ID NO: 116
  derived and/or modified CDS sequence (AUadapt) from InfluenzaA__AEO01267__HA

SEQ ID NO: 7609 - RNA, 1701 nt, Artificial Sequence; identical to SEQ ID NO: 116
  derived and/or modified CDS sequence (AUadapt) from InfluenzaA__AEO01268__HA

SEQ ID NO: 7610 - RNA, 1701 nt, Artificial Sequence
  derived and/or modified CDS sequence (AUadapt) from InfluenzaA__AEO01269__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcauggagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 7611 - RNA, 1701 nt, Artificial Sequence; identical to SEQ ID NO: 4078
  derived and/or modified CDS sequence (AUadapt) from InfluenzaA__AEO01270__HA

SEQ ID NO: 7612 - RNA, 1701 nt, Artificial Sequence
  derived and/or modified CDS sequence (AUadapt) from InfluenzaA__AEO01271__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagcacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7613 - RNA, 1701 nt, Artificial Sequence; identical to SEQ ID NO: 116
  derived and/or modified CDS sequence (AUadapt) from InfluenzaA__AEO01272__HA

SEQ ID NO: 7614 - RNA, 1701 nt, Artificial Sequence; identical to SEQ ID NO: 116
  derived and/or modified CDS sequence (AUadapt) from InfluenzaA__AEO01273__HA

SEQ ID NO: 7615 - RNA, 1701 nt, Artificial Sequence; identical to SEQ ID NO: 116
  derived and/or modified CDS sequence (AUadapt) from InfluenzaA__AEO01274__HA

SEQ ID NO: 7616 - RNA, 1701 nt, Artificial Sequence; identical to SEQ ID NO: 5082
  derived and/or modified CDS sequence (AUadapt) from InfluenzaA__AEO01275__HA

SEQ ID NO: 7617 - RNA, 1701 nt, Artificial Sequence
  derived and/or modified CDS sequence (AUadapt) from InfluenzaA__AEO01276__HA
augaaggccauccuggugguccuccuguacaccuucgccaccgcgaacgccgacacgcugugcaucggcuaccacgccaacaacucgaccgacaccguggacaccgugcucaagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccgaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7618 - RNA, 1701 nt, Artificial Sequence; identical to SEQ ID NO: 116
  derived and/or modified CDS sequence (AUadapt) from InfluenzaA__AEO01277__HA

SEQ ID NO: 7619 - RNA, 1701 nt, Artificial Sequence
  derived and/or modified CDS sequence (AUadapt) from InfluenzaA__AEO01278__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgccaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 7620 - RNA, 1701 nt, Artificial Sequence
  derived and/or modified CDS sequence (AUadapt) from InfluenzaA__AEO01279__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcacggccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7621 - RNA, 1701 nt, Artificial Sequence
  derived and/or modified CDS sequence (AUadapt) from InfluenzaA__AEO01282__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcaacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7622 - RNA, 1701 nt, Artificial Sequence; identical to SEQ ID NO: 4016
  derived and/or modified CDS sequence (AUadapt) from InfluenzaA__AEO01283__HA

SEQ ID NO: 7623 - RNA, 1701 nt, Artificial Sequence
  derived and/or modified CDS sequence (AUadapt) from InfluenzaA__AEO01284__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucaacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 7624 - RNA, 1701 nt, Artificial Sequence; identical to SEQ ID NO: 4015
  derived and/or modified CDS sequence (AUadapt) from InfluenzaA__AEO01285__HA

SEQ ID NO: 7625 - RNA, 1701 nt, Artificial Sequence; identical to SEQ ID NO: 4108
  derived and/or modified CDS sequence (AUadapt) from InfluenzaA__AEO01286__HA

SEQ ID NO: 7626 - RNA, 1701 nt, Artificial Sequence
  derived and/or modified CDS sequence (AUadapt) from InfluenzaA__AEO01287__HA
augaaggccauccuggugguccuccuguacaccuucgccaccgcgaacucggacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugucgaccgccuccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 7627 - RNA, 1701 nt, Artificial Sequence; identical to SEQ ID NO: 3267
  derived and/or modified CDS sequence (AUadapt) from InfluenzaA__AEO01288__HA

SEQ ID NO: 7628 - RNA, 1701 nt, Artificial Sequence; identical to SEQ ID NO: 116
  derived and/or modified CDS sequence (AUadapt) from InfluenzaA__AEO01289__HA

SEQ ID NO: 7629 - RNA, 1701 nt, Artificial Sequence
  derived and/or modified CDS sequence (AUadapt) from InfluenzaA__AEO01290__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugagcuuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 7630 - RNA, 1701 nt, Artificial Sequence; identical to SEQ ID NO: 116
  derived and/or modified CDS sequence (AUadapt) from InfluenzaA__AEO01291__HA

SEQ ID NO: 7631 - RNA, 1701 nt, Artificial Sequence; identical to SEQ ID NO: 116
  derived and/or modified CDS sequence (AUadapt) from InfluenzaA__AEO01292__HA

SEQ ID NO: 7632 - RNA, 1701 nt, Artificial Sequence
  derived and/or modified CDS sequence (AUadapt) from InfluenzaA__AEO01294__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7633 - RNA, 1701 nt, Artificial Sequence
  derived and/or modified CDS sequence (AUadapt) from InfluenzaA__AEO01295__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccaacucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacuacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7634 - RNA, 1701 nt, Artificial Sequence; identical to SEQ ID NO: 116
  derived and/or modified CDS sequence (AUadapt) from InfluenzaA__AEO01296__HA

SEQ ID NO: 7635 - RNA, 1701 nt, Artificial Sequence; identical to SEQ ID NO: 4596
  derived and/or modified CDS sequence (AUadapt) from InfluenzaA__AEO01297__HA

SEQ ID NO: 7636 - RNA, 1701 nt, Artificial Sequence; identical to SEQ ID NO: 4601
  derived and/or modified CDS sequence (AUadapt) from InfluenzaA__AEO01298__HA

SEQ ID NO: 7637 - RNA, 1701 nt, Artificial Sequence; identical to SEQ ID NO: 116
  derived and/or modified CDS sequence (AUadapt) from InfluenzaA__AEO01299__HA

SEQ ID NO: 7638 - RNA, 1701 nt, Artificial Sequence; identical to SEQ ID NO: 116
  derived and/or modified CDS sequence (AUadapt) from InfluenzaA__AEO01300__HA

SEQ ID NO: 7639 - RNA, 1701 nt, Artificial Sequence; identical to SEQ ID NO: 116
  derived and/or modified CDS sequence (AUadapt) from InfluenzaA__AEO01301__HA

SEQ ID NO: 7640 - RNA, 1701 nt, Artificial Sequence; identical to SEQ ID NO: 116
  derived and/or modified CDS sequence (AUadapt) from InfluenzaA__AEO01302__HA

SEQ ID NO: 7641 - RNA, 1701 nt, Artificial Sequence; identical to SEQ ID NO: 4511
  derived and/or modified CDS sequence (AUadapt) from InfluenzaA__AEO01303__HA

SEQ ID NO: 7642 - RNA, 1701 nt, Artificial Sequence
  derived and/or modified CDS sequence (AUadapt) from InfluenzaA__AEO01304__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaaggccucguccuggcccaaccacgacagcaacaagggggucaccgccgccugcccgcacgcgggcgccaaguccuucuacaagaaccugaucuggcucgugaagaaggggaacucguaccccaagcuguccaagagcuacaucaacgacaagggcaagggggugcugguccucuggggcauccaccaccccucgaccuccgccgaccagcagagccuguaccagaacgccgacgccuacguguucgugggcaccucccgguacucgaagaaguucaagcccgagaucgcgauccgcccgaagguccgggaccaggaggggcgcaugaacuacuacuggacgcugguggagcccggcgacaagaucaccuucgaggccaccgggaaccucguggucccccgguacgccuucgccauggagcgcaacgccggcuccggcaucaucaucagcgacacccccgugcacgacugcaacacgaccugccagaccccgaagggggcgaucaacaccucccugcccuuccagaacauccaccccaucacgaucggcaagugccccaaguacgucaagucgaccaagcugcggcucgccaccgggcugcgcaacgugccguccauccagagccggggccuguucggggccaucgccggcuucaucgagggcggguggaccggcaugguggacgggugguacggcuaccaccaccagaacgagcagggguccggcuacgccgcggaccucaagucgacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggcgaagcugaaccgggaggagaucgacggggugaagcucgagagcacccgcaucuaccagauccuggccaucuacuccaccgucgccucgagccuggugcucguggucucccugggcgccaucucguucuggaugugcuccaacggcagccugcagugccggaucugcaucuga

SEQ ID NO: 7643 - RNA, 1701 nt, Artificial Sequence
  derived and/or modified CDS sequence (AUadapt) from InfluenzaA__AEO01305__HA
augaaggccauccuggugguccuccuguacaccuucgccaccgcgucggccgacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugucgaccgcguccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 7644 - RNA, 1701 nt, Artificial Sequence; identical to SEQ ID NO: 116
  derived and/or modified CDS sequence (AUadapt) from InfluenzaA__AEO01306__HA

SEQ ID NO: 7645 - RNA, 1701 nt, Artificial Sequence; identical to SEQ ID NO: 116
  derived and/or modified CDS sequence (AUadapt) from InfluenzaA__AEO01307__HA

SEQ ID NO: 7646 - RNA, 1701 nt, Artificial Sequence; identical to SEQ ID NO: 116
  derived and/or modified CDS sequence (AUadapt) from InfluenzaA__AEO01308__HA

SEQ ID NO: 7647 - RNA, 1701 nt, Artificial Sequence
  derived and/or modified CDS sequence (AUadapt) from InfluenzaA__AEO01309__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgggaggagaucaacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 7648 - RNA, 1701 nt, Artificial Sequence
  derived and/or modified CDS sequence (AUadapt) from InfluenzaA__AEO01310__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgaccggggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7649 - RNA, 1701 nt, Artificial Sequence; identical to SEQ ID NO: 116
  derived and/or modified CDS sequence (AUadapt) from InfluenzaA__AEO01311__HA

SEQ ID NO: 7650 - RNA, 1701 nt, Artificial Sequence
  derived and/or modified CDS sequence (AUadapt) from InfluenzaA__AEO01312__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaucguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7651 - RNA, 1701 nt, Artificial Sequence; identical to SEQ ID NO: 3267
  derived and/or modified CDS sequence (AUadapt) from InfluenzaA__AEO01313__HA

SEQ ID NO: 7652 - RNA, 1701 nt, Artificial Sequence; identical to SEQ ID NO: 4078
  derived and/or modified CDS sequence (AUadapt) from InfluenzaA__AEO01314__HA

SEQ ID NO: 7653 - RNA, 1701 nt, Artificial Sequence
  derived and/or modified CDS sequence (AUadapt) from InfluenzaA__AEO01315__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaaccgcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacgggacgugcuaccccggcgacuucaucgacuacgaggagcuccgggagcagcugucguccgugagcuccuucgagcgguucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgcuacucgaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacgggagccugcagugccgcaucugcaucuga

SEQ ID NO: 7654 - RNA, 1701 nt, Artificial Sequence; identical to SEQ ID NO: 116
  derived and/or modified CDS sequence (AUadapt) from InfluenzaA__AEO01316__HA

SEQ ID NO: 7655 - RNA, 1701 nt, Artificial Sequence; identical to SEQ ID NO: 116
  derived and/or modified CDS sequence (AUadapt) from InfluenzaA__AEO01317__HA

SEQ ID NO: 7656 - RNA, 1701 nt, Artificial Sequence; identical to SEQ ID NO: 116
  derived and/or modified CDS sequence (AUadapt) from InfluenzaA__AEO01318__HA

SEQ ID NO: 7657 - RNA, 1701 nt, Artificial Sequence; identical to SEQ ID NO: 116
  derived and/or modified CDS sequence (AUadapt) from InfluenzaA__AEO01319__HA

SEQ ID NO: 7658 - RNA, 1701 nt, Artificial Sequence
  derived and/or modified CDS sequence (AUadapt) from InfluenzaA__AEO01321__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggcccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcuggagagcacccgcaucuaccagauccucgccaucuacuccaccguggccucgagccugguccugguggugucccucggggccaucucguucuggaugugcuccaacggcagccugcagugccggaucugcaucuga

SEQ ID NO: 7659 - RNA, 1701 nt, Artificial Sequence; identical to SEQ ID NO: 116
  derived and/or modified CDS sequence (AUadapt) from InfluenzaA__AEO01322__HA

SEQ ID NO: 7660 - RNA, 1701 nt, Artificial Sequence; identical to SEQ ID NO: 4596
  derived and/or modified CDS sequence (AUadapt) from InfluenzaA__AEO01323__HA

SEQ ID NO: 7661 - RNA, 1701 nt, Artificial Sequence; identical to SEQ ID NO: 4511
  derived and/or modified CDS sequence (AUadapt) from InfluenzaA__AEO01324__HA

SEQ ID NO: 7662 - RNA, 1701 nt, Artificial Sequence; identical to SEQ ID NO: 116
  derived and/or modified CDS sequence (AUadapt) from InfluenzaA__AEO01325__HA

SEQ ID NO: 7663 - RNA, 1701 nt, Artificial Sequence
  derived and/or modified CDS sequence (AUadapt) from InfluenzaA__AEO01326__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccaggacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7664 - RNA, 1701 nt, Artificial Sequence; identical to SEQ ID NO: 116
  derived and/or modified CDS sequence (AUadapt) from InfluenzaA__AEO01327__HA

SEQ ID NO: 7665 - RNA, 1701 nt, Artificial Sequence; identical to SEQ ID NO: 7623
  derived and/or modified CDS sequence (AUadapt) from InfluenzaA__AEO01328__HA

SEQ ID NO: 7666 - RNA, 1701 nt, Artificial Sequence; identical to SEQ ID NO: 116
  derived and/or modified CDS sequence (AUadapt) from InfluenzaA__AEO01330__HA

SEQ ID NO: 7667 - RNA, 1701 nt, Artificial Sequence
  derived and/or modified CDS sequence (AUadapt) from InfluenzaA__AEO01331__HA
augaaggccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccucaucuggcuggucaagaaggggaacucguaccccaagcuguccaagagcuacaucaacgacaagggcaaggaggugcucgugcugugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 7668 - RNA, 1701 nt, Artificial Sequence
  derived and/or modified CDS sequence (AUadapt) from InfluenzaA__AEO01332__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggccugucccgguacagcaagaaguucaagcccgagaucgccauccgcccgaagguccgggagcaggagggccgcaugaacuacuacuggacgcucguggagcccggggacaagaucaccuucgaggcgaccggcaaccugguggucccccgguacgccuucgccauggagcgcaacgccggguccggcaucgugaucucggacacccccgugcacgacugcaacacgaccugccagaccccgaagggcgccaucaacaccucccugcccuuccagaacauccaccccaucacgaucgggaagugccccaaguacgucaagagcaccaagcuccggcuggcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggucaacuccgugaucgagaagaugaacacccaguucaccgccgucggcaaggaguucaaccaccuggagaagcgcauggagaaccucaacaagaagguggacgacggcuuccuggacaucuggacguacaacgccgagcugcucgugcugcuggagaacgagcggacccucgacuaccacgacucgaacgucaagaaccuguacgagaaggugcgcucccagcugaagaccaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgucaagcuggagucgacccgcaucuaccagauccuggcgaucuacuccaccguggccagcucgcucgugcuggucgugucccugggggccaucagcuucuggaugugcuccaacggcagccuccagugccggaucugcaucuga

SEQ ID NO: 7669 - RNA, 1701 nt, Artificial Sequence; identical to SEQ ID NO: 5082
  derived and/or modified CDS sequence (AUadapt) from InfluenzaA__AEO01333__HA

SEQ ID NO: 7670 - RNA, 1701 nt, Artificial Sequence
  derived and/or modified CDS sequence (AUadapt) from InfluenzaA__AEO01334__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7671 - RNA, 1701 nt, Artificial Sequence; identical to SEQ ID NO: 4511
  derived and/or modified CDS sequence (AUadapt) from InfluenzaA__AEO01335__HA

SEQ ID NO: 7672 - RNA, 1701 nt, Artificial Sequence
  derived and/or modified CDS sequence (AUadapt) from InfluenzaA__AEO01336__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucggggagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7673 - RNA, 1701 nt, Artificial Sequence
  derived and/or modified CDS sequence (AUadapt) from InfluenzaA__AEO01337__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7674 - RNA, 1701 nt, Artificial Sequence; identical to SEQ ID NO: 116
  derived and/or modified CDS sequence (AUadapt) from InfluenzaA__AEO01338__HA

SEQ ID NO: 7675 - RNA, 1701 nt, Artificial Sequence; identical to SEQ ID NO: 6786
  derived and/or modified CDS sequence (AUadapt) from InfluenzaA__AEO01339__HA

SEQ ID NO: 7676 - RNA, 1701 nt, Artificial Sequence; identical to SEQ ID NO: 7632
  derived and/or modified CDS sequence (AUadapt) from InfluenzaA__AEO01340__HA

SEQ ID NO: 7677 - RNA, 1701 nt, Artificial Sequence; identical to SEQ ID NO: 7632
  derived and/or modified CDS sequence (AUadapt) from InfluenzaA__AEO01341__HA

SEQ ID NO: 7678 - RNA, 1701 nt, Artificial Sequence; identical to SEQ ID NO: 116
  derived and/or modified CDS sequence (AUadapt) from InfluenzaA__AEO01342__HA

SEQ ID NO: 7679 - RNA, 1701 nt, Artificial Sequence
  derived and/or modified CDS sequence (AUadapt) from InfluenzaA__AEO01343__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7680 - RNA, 1701 nt, Artificial Sequence
  derived and/or modified CDS sequence (AUadapt) from InfluenzaA__AEO01344__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacguccaaguacucgaagaaguucaagcccgagaucgccauccggccgaagguccgcgaccaggagggccggaugaacuacuacuggacccugguggagcccggggacaagaucaccuucgaggcgaccggcaaccugguggucccccgcuacgccuucgccauggagcggaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcuggagagcacccggaucuaccagauccucgcgaucuacuccaccgucgccucgagccuggugcugguggucucccucggggccaucucguucuggaugugcuccaacggcagccugcagugccgcaucugcaucuga

SEQ ID NO: 7681 - RNA, 1701 nt, Artificial Sequence; identical to SEQ ID NO: 6786
  derived and/or modified CDS sequence (AUadapt) from InfluenzaA__AEO01345__HA

SEQ ID NO: 7682 - RNA, 1701 nt, Artificial Sequence; identical to SEQ ID NO: 116
  derived and/or modified CDS sequence (AUadapt) from InfluenzaA__AEO01346__HA

SEQ ID NO: 7683 - RNA, 1701 nt, Artificial Sequence
  derived and/or modified CDS sequence (AUadapt) from InfluenzaA__AEO01347__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucggggagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7684 - RNA, 1701 nt, Artificial Sequence
  derived and/or modified CDS sequence (AUadapt) from InfluenzaA__AEO01348__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggagcaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 7685 - RNA, 1701 nt, Artificial Sequence
  derived and/or modified CDS sequence (AUadapt) from InfluenzaA__AEO01349__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgagaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccaaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7686 - RNA, 1701 nt, Artificial Sequence
  derived and/or modified CDS sequence (AUadapt) from InfluenzaA__AEO01350__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagcacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7687 - RNA, 1701 nt, Artificial Sequence; identical to SEQ ID NO: 116
  derived and/or modified CDS sequence (AUadapt) from InfluenzaA__AEO01351__HA

SEQ ID NO: 7688 - RNA, 1701 nt, Artificial Sequence; identical to SEQ ID NO: 4078
  derived and/or modified CDS sequence (AUadapt) from InfluenzaA__AEO01352__HA

SEQ ID NO: 7689 - RNA, 1701 nt, Artificial Sequence
  derived and/or modified CDS sequence (AUadapt) from InfluenzaA__AEO01353__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucuuccugggggccaucuccuucuggaugugcagcaacggcucccugcagugccggaucugcaucuga

SEQ ID NO: 7690 - RNA, 1701 nt, Artificial Sequence
  derived and/or modified CDS sequence (AUadapt) from InfluenzaA__AEO01354__HA
augaaggccauccuggugguccuccuguacaaguucgccaccgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7691 - RNA, 1701 nt, Artificial Sequence; identical to SEQ ID NO: 4334
  derived and/or modified CDS sequence (AUadapt) from InfluenzaA__AEO01355__HA

SEQ ID NO: 7692 - RNA, 1701 nt, Artificial Sequence; identical to SEQ ID NO: 116
  derived and/or modified CDS sequence (AUadapt) from InfluenzaA__AEO01356__HA

SEQ ID NO: 7693 - RNA, 1701 nt, Artificial Sequence
  derived and/or modified CDS sequence (AUadapt) from InfluenzaA__AEO01358__HA
augaaggccauccuggugguccuccuguacaccuucgccaccgcgaacgccgacacgcugugcgugggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 7694 - RNA, 1701 nt, Artificial Sequence; identical to SEQ ID NO: 4334
  derived and/or modified CDS sequence (AUadapt) from InfluenzaA__AEO01359__HA

SEQ ID NO: 7695 - RNA, 1701 nt, Artificial Sequence; identical to SEQ ID NO: 7667
  derived and/or modified CDS sequence (AUadapt) from InfluenzaA__AEO01360__HA

SEQ ID NO: 7696 - RNA, 1701 nt, Artificial Sequence; identical to SEQ ID NO: 3267
  derived and/or modified CDS sequence (AUadapt) from InfluenzaA__AEO01361__HA

SEQ ID NO: 7697 - RNA, 1701 nt, Artificial Sequence; identical to SEQ ID NO: 7667
  derived and/or modified CDS sequence (AUadapt) from InfluenzaA__AEO01362__HA

SEQ ID NO: 7698 - RNA, 1701 nt, Artificial Sequence; identical to SEQ ID NO: 4078
  derived and/or modified CDS sequence (AUadapt) from InfluenzaA__AEO01363__HA

SEQ ID NO: 7699 - RNA, 1701 nt, Artificial Sequence
  derived and/or modified CDS sequence (AUadapt) from InfluenzaA__AEO01365__HA
augaaggccauccuggugguccuccuguacaccuucgccaccgcgaacgccgacacgcugugcaucggcuaccacgccaacaacucgaccgacaccguggacaccgugcucaagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcuccgccgggucgggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggcgaccggccuccgcaacgucccgucgauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 7700 - RNA, 1701 nt, Artificial Sequence
  derived and/or modified CDS sequence (AUadapt) from InfluenzaA__AEO01366__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcuccacgaccugccagaccccgaagggcgccaucaacaccagccugcccuuccagaacgugcaccccaucaccaucgggaagugccccaaguacgucaaguccaccaagcugcggcucgcgaccggccugcgcaacgugccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 7701 - RNA, 1701 nt, Artificial Sequence; identical to SEQ ID NO: 7672
  derived and/or modified CDS sequence (AUadapt) from InfluenzaA__AEO01367__HA

SEQ ID NO: 7702 - RNA, 1701 nt, Artificial Sequence
  derived and/or modified CDS sequence (AUadapt) from InfluenzaA__AEO01368__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaacaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7703 - RNA, 1701 nt, Artificial Sequence; identical to SEQ ID NO: 116
  derived and/or modified CDS sequence (AUadapt) from InfluenzaA__AEO01369__HA

SEQ ID NO: 7704 - RNA, 1701 nt, Artificial Sequence; identical to SEQ ID NO: 7632
  derived and/or modified CDS sequence (AUadapt) from InfluenzaA__AEO01370__HA

SEQ ID NO: 7705 - RNA, 1701 nt, Artificial Sequence; identical to SEQ ID NO: 7679
  derived and/or modified CDS sequence (AUadapt) from InfluenzaA__AEO01371__HA

SEQ ID NO: 7706 - RNA, 1701 nt, Artificial Sequence; identical to SEQ ID NO: 4511
  derived and/or modified CDS sequence (AUadapt) from InfluenzaA__AEO01372__HA

SEQ ID NO: 7707 - RNA, 1701 nt, Artificial Sequence; identical to SEQ ID NO: 4511
  derived and/or modified CDS sequence (AUadapt) from InfluenzaA__AEO01373__HA

SEQ ID NO: 7708 - RNA, 1701 nt, Artificial Sequence
  derived and/or modified CDS sequence (AUadapt) from InfluenzaA__AEO01374__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacaucaagucgaccaagcugcggcucgcgaccggccugcgcaacgugccguccauccagagccgggggcuguucggcgccaucgccggguucaucgagggcggcuggacggggauggucgacggcugguacggguaccaccaccagaacgagcagggcuccggguacgccgccgaccucaagucgacccagcacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7709 - RNA, 1701 nt, Artificial Sequence; identical to SEQ ID NO: 7683
  derived and/or modified CDS sequence (AUadapt) from InfluenzaA__AEO01375__HA

SEQ ID NO: 7710 - RNA, 1701 nt, Artificial Sequence; identical to SEQ ID NO: 116
  derived and/or modified CDS sequence (AUadapt) from InfluenzaA__AEO01376__HA

SEQ ID NO: 7711 - RNA, 1701 nt, Artificial Sequence; identical to SEQ ID NO: 5082
  derived and/or modified CDS sequence (AUadapt) from InfluenzaA__AEO01377__HA

SEQ ID NO: 7712 - RNA, 1701 nt, Artificial Sequence
  derived and/or modified CDS sequence (AUadapt) from InfluenzaA__AEO01378__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7713 - RNA, 1701 nt, Artificial Sequence; identical to SEQ ID NO: 4078
  derived and/or modified CDS sequence (AUadapt) from InfluenzaA__AEO01379__HA

SEQ ID NO: 7714 - RNA, 1701 nt, Artificial Sequence; identical to SEQ ID NO: 7683
  derived and/or modified CDS sequence (AUadapt) from InfluenzaA__AEO01380__HA

SEQ ID NO: 7715 - RNA, 1701 nt, Artificial Sequence; identical to SEQ ID NO: 7683
  derived and/or modified CDS sequence (AUadapt) from InfluenzaA__AEO01381__HA

SEQ ID NO: 7716 - RNA, 1701 nt, Artificial Sequence; identical to SEQ ID NO: 4078
  derived and/or modified CDS sequence (AUadapt) from InfluenzaA__AEO01382__HA

SEQ ID NO: 7717 - RNA, 1701 nt, Artificial Sequence; identical to SEQ ID NO: 4511
  derived and/or modified CDS sequence (AUadapt) from InfluenzaA__AEO01383__HA

SEQ ID NO: 7718 - RNA, 1701 nt, Artificial Sequence
  derived and/or modified CDS sequence (AUadapt) from InfluenzaA__AEO01384__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucagcccccugcaccucgggaagugcaacaucgccggcuggauccuggggaacccggagugcgagucccugucgaccgccuccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgcggccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 7719 - RNA, 1701 nt, Artificial Sequence
  derived and/or modified CDS sequence (AUadapt) from InfluenzaA__AEO01385__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccaacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 7720 - RNA, 1701 nt, Artificial Sequence; identical to SEQ ID NO: 7623
  derived and/or modified CDS sequence (AUadapt) from InfluenzaA__AEO01386__HA

SEQ ID NO: 7721 - RNA, 1701 nt, Artificial Sequence
  derived and/or modified CDS sequence (AUadapt) from InfluenzaA__AEO01387__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacauccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacucgaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgcgaucuacuccaccgucgccagcucgcuggugcugguggucucccucggggccaucagcuucuggaugugcuccaacggcagccugcagugccggaucugcaucuga

SEQ ID NO: 7722 - RNA, 1701 nt, Artificial Sequence
  derived and/or modified CDS sequence (AUadapt) from InfluenzaA__AEO01388__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagaaguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaccaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7723 - RNA, 1701 nt, Artificial Sequence
  derived and/or modified CDS sequence (AUadapt) from InfluenzaA__AEO01389__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcaccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7724 - RNA, 1701 nt, Artificial Sequence
  derived and/or modified CDS sequence (AUadapt) from InfluenzaA__AEO01390__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucguggagaccucccgguacagcaagaaggucaagcccgagaucgccauccgcccgcgggugcgcgaccaggagggccggaugaacuacuacuggacgcugguggagcccggcgacaagaucaccuucgaggcgaccgggaaccucgucgugccccgcuacgccuucgccauggagcggaacgccggcuccgggaucaucaucucggacacccccgugcacgacugcaacacgaccugccagaccccgaagggcgccaucaacaccucccugcccuuccagaacauccaccccaucacgaucggcaagugccccaaguacgucaagagcaccaagcugcgccucgcgaccgggcugcggaacgugccguccauccagucgcgcggccuguucggggccaucgccggcuucaucgagggcggcuggaccggcaugguggacgggugguacggcuaccaccaccagaacgagcagggguccggcuacgccgccgaccucaagagcacgcagcacgcgaucgacgagaucaccaacaaggucaacuccgugaucgagaagaugaacacccaguucaccgccgucgggaaggaguucaaccaccuggagaagcggaucgagaaccugaacaagaagguggacgacggcuuccucgacaucuggacguacaacgccgagcugcuggugcuccuggagaacgagcgcacccuggacuaccacgacucgaacgucaagaaccucuacgagaaggugcggucccagcugaagaacaacgccaaggagaucggcaacgggugcuucgaguucuaccacaagugcgacaacacgugcauggagagcgugaagaacggcaccuacgacuaccccaaguacuccgaggucgccaagcugaaccgcgaggagaucaacggggugaagcucgagucgacccggaucuaccagauccuggcgaucuacuccaccguggccagcucgcugguccucguggugucccugggcgccaucagcuucuggaugugcuccaacgggagccugcagugccgcaucugcaucuga

SEQ ID NO: 7725 - RNA, 1701 nt, Artificial Sequence; identical to SEQ ID NO: 7623
  derived and/or modified CDS sequence (AUadapt) from InfluenzaA__AEO01391__HA

SEQ ID NO: 7726 - RNA, 1701 nt, Artificial Sequence; identical to SEQ ID NO: 7632
  derived and/or modified CDS sequence (AUadapt) from InfluenzaA__AEO01392__HA

SEQ ID NO: 7727 - RNA, 1701 nt, Artificial Sequence; identical to SEQ ID NO: 4511
  derived and/or modified CDS sequence (AUadapt) from InfluenzaA__AEO01393__HA

SEQ ID NO: 7728 - RNA, 1701 nt, Artificial Sequence; identical to SEQ ID NO: 4015
  derived and/or modified CDS sequence (AUadapt) from InfluenzaA__AEO01394__HA

SEQ ID NO: 7729 - RNA, 1701 nt, Artificial Sequence
  derived and/or modified CDS sequence (AUadapt) from InfluenzaA__AEO01395__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuuccucgacuacgaggagcugcgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccucaucuggcuggugaagaaggggaacucguaccccaagcuguccaagagcuacaucaacgacaagggcaaggaggugcucguccugugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgagccucgugcugguggucucccugggggccaucucguucuggaugugcuccaacggcagccuccagugccggaucugcaucuga

SEQ ID NO: 7730 - RNA, 1701 nt, Artificial Sequence; identical to SEQ ID NO: 4015
  derived and/or modified CDS sequence (AUadapt) from InfluenzaA__AEO01396__HA

SEQ ID NO: 7731 - RNA, 1701 nt, Artificial Sequence
  derived and/or modified CDS sequence (AUadapt) from InfluenzaA__AEO01397__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacacggacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccugguggucccccgguacgcguucgccauggagcgcaacgccggguccggcaucaucaucagcgacacccccgugcacgacugcaacacgaccugccagaccccgaagggcgccaucaacaccucccuccccuuccagaacauccaccccaucaccaucgggaagugccccaaguacgucaagucgaccaagcugcggcuggccacgggccuccgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgccaucuacuccaccgucgcgucgagccuggugcugguggucucccucggggccaucucguucuggaugugcuccaacggcagccugcagugccggaucugcaucuga

SEQ ID NO: 7732 - RNA, 1701 nt, Artificial Sequence
  derived and/or modified CDS sequence (AUadapt) from InfluenzaA__AEO01398__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccaacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 7733 - RNA, 1701 nt, Artificial Sequence; identical to SEQ ID NO: 7632
  derived and/or modified CDS sequence (AUadapt) from InfluenzaA__AEO01399__HA

SEQ ID NO: 7734 - RNA, 1701 nt, Artificial Sequence; identical to SEQ ID NO: 116
  derived and/or modified CDS sequence (AUadapt) from InfluenzaA__AEO01402__HA

SEQ ID NO: 7735 - RNA, 1701 nt, Artificial Sequence; identical to SEQ ID NO: 4078
  derived and/or modified CDS sequence (AUadapt) from InfluenzaA__AEO01403__HA

SEQ ID NO: 7736 - RNA, 1701 nt, Artificial Sequence; identical to SEQ ID NO: 116
  derived and/or modified CDS sequence (AUadapt) from InfluenzaA__AEO01404__HA

SEQ ID NO: 7737 - RNA, 1701 nt, Artificial Sequence
  derived and/or modified CDS sequence (AUadapt) from InfluenzaA__AEO01405__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgaccaugaucuaccagauccuggcgaucuacuccaccgucgccagcucgcuggugcucguggucucccugggggccaucagcuucuggaugugcuccaacggcagccugcagugccgcaucugcaucuga

SEQ ID NO: 7738 - RNA, 1701 nt, Artificial Sequence
  derived and/or modified CDS sequence (AUadapt) from InfluenzaA__AEO01407__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucaacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7739 - RNA, 1701 nt, Artificial Sequence
  derived and/or modified CDS sequence (AUadapt) from InfluenzaA__AEO01408__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7740 - RNA, 1701 nt, Artificial Sequence; identical to SEQ ID NO: 4016
  derived and/or modified CDS sequence (AUadapt) from InfluenzaA__AEO01409__HA

SEQ ID NO: 7741 - RNA, 1701 nt, Artificial Sequence; identical to SEQ ID NO: 7632
  derived and/or modified CDS sequence (AUadapt) from InfluenzaA__AEO01410__HA

SEQ ID NO: 7742 - RNA, 1701 nt, Artificial Sequence; identical to SEQ ID NO: 6333
  derived and/or modified CDS sequence (AUadapt) from InfluenzaA__AEO01411__HA

SEQ ID NO: 7743 - RNA, 1701 nt, Artificial Sequence; identical to SEQ ID NO: 3267
  derived and/or modified CDS sequence (AUadapt) from InfluenzaA__AEO01412__HA

SEQ ID NO: 7744 - RNA, 1701 nt, Artificial Sequence
  derived and/or modified CDS sequence (AUadapt) from InfluenzaA__AEO01413__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcucaagagcaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 7745 - RNA, 1701 nt, Artificial Sequence
  derived and/or modified CDS sequence (AUadapt) from InfluenzaA__AEO01414__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacacgggguccggcaucaucaucucggacacccccgugcacgacugcuccacgaccugccagaccccgaagggcgccaucaacaccagccugcccuuccagaacgugcaccccaucaccaucgggaagugccccaaguacgucaaguccaccaagcugcggcucgccacgggccugcgcaacgugccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggucaacucggugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggccaucuacagcaccguggcgucgucccuggugcucgucgugagccugggggccaucuccuucuggaugugcagcaacggcucccugcagugccggaucugcaucuga

SEQ ID NO: 7746 - RNA, 1701 nt, Artificial Sequence; identical to SEQ ID NO: 6545
  derived and/or modified CDS sequence (AUadapt) from InfluenzaA__AEO01416__HA

SEQ ID NO: 7747 - RNA, 1701 nt, Artificial Sequence; identical to SEQ ID NO: 4078
  derived and/or modified CDS sequence (AUadapt) from InfluenzaA__AEO01418__HA

SEQ ID NO: 7748 - RNA, 1701 nt, Artificial Sequence; identical to SEQ ID NO: 4078
  derived and/or modified CDS sequence (AUadapt) from InfluenzaA__AEO01419__HA

SEQ ID NO: 7749 - RNA, 1701 nt, Artificial Sequence
  derived and/or modified CDS sequence (AUadapt) from InfluenzaA__AEO01420__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaguacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccaacucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7750 - RNA, 1701 nt, Artificial Sequence
  derived and/or modified CDS sequence (AUadapt) from InfluenzaA__AEO01421__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagaaguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7751 - RNA, 1701 nt, Artificial Sequence
  derived and/or modified CDS sequence (AUadapt) from InfluenzaA__AEO01422__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggggucaccgccgccugcccgcacgccggcgcgaaguccuucuacaagaaccugaucuggcucgugaagaaggggaaccuguaccccaagcugagcaaguccuacaucaacgacaagggcaaggaggugcucguccugugggggauccaccaccccucgaccagcgccgaccagcagucccuguaccagaacgccgacgccuacguguucgugggcaccagccgguacuccaagaaguucaagcccgagaucgccauccgcccgaagguccgggaccaggagggccgcaugaacuacuacuggacgcucguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcuccggcuggcgaccggccugcgcaacgucccgucgauccagucccggggccucuucggcgccaucgccggguucaucgagggcggcuggaccgggaugguggacggcugguacggguaccaccaccagaacgagcagggcagcggguacgccgccgaccugaaguccacgcagcacgcgaucgacgagaucaccaacaaggugaacucggucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgggaggagaucaacggcgugaagcuggaguccacccgcaucuaccagauccuggcgaucuacagcaccgucgccuccucgcucgugcugguggucagccugggggccaucuccuucuggaugugcagcaacggcucccuccagugccggaucugcaucuga

SEQ ID NO: 7752 - RNA, 1701 nt, Artificial Sequence
  derived and/or modified CDS sequence (AUadapt) from InfluenzaA__AEO01423__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucaccauccgcccgaaggugcgggaccaggagggccgcaugaacuacuacuggacccuggucgagcccggggacaagaucaccuucgaggccacgggcaaccucguggugccccgguacgcguucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 7753 - RNA, 1701 nt, Artificial Sequence; identical to SEQ ID NO: 7750
  derived and/or modified CDS sequence (AUadapt) from InfluenzaA__AEO01424__HA

SEQ ID NO: 7754 - RNA, 1701 nt, Artificial Sequence; identical to SEQ ID NO: 7750
  derived and/or modified CDS sequence (AUadapt) from InfluenzaA__AEO01425__HA

SEQ ID NO: 7755 - RNA, 1701 nt, Artificial Sequence; identical to SEQ ID NO: 116
  derived and/or modified CDS sequence (AUadapt) from InfluenzaA__AEO01426__HA

SEQ ID NO: 7756 - RNA, 1701 nt, Artificial Sequence
  derived and/or modified CDS sequence (AUadapt) from InfluenzaA__AEO01427__HA
augaaggccauccuggugguccuccuguacaccuucgccaccgcgaacucggacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugucgaccgccuccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 7757 - RNA, 1701 nt, Artificial Sequence
  derived and/or modified CDS sequence (AUadapt) from InfluenzaA__AEO01428__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 7758 - RNA, 1701 nt, Artificial Sequence; identical to SEQ ID NO: 4078
  derived and/or modified CDS sequence (AUadapt) from InfluenzaA__AEO01429__HA

SEQ ID NO: 7759 - RNA, 1701 nt, Artificial Sequence
  derived and/or modified CDS sequence (AUadapt) from InfluenzaA__AEO01430__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgacggcgccaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7760 - RNA, 1701 nt, Artificial Sequence; identical to SEQ ID NO: 7632
  derived and/or modified CDS sequence (AUadapt) from InfluenzaA__AEO01431__HA

SEQ ID NO: 7761 - RNA, 1701 nt, Artificial Sequence; identical to SEQ ID NO: 116
  derived and/or modified CDS sequence (AUadapt) from InfluenzaA__AEO01432__HA

SEQ ID NO: 7762 - RNA, 1701 nt, Artificial Sequence
  derived and/or modified CDS sequence (AUadapt) from InfluenzaA__AEO01434__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucggggagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucggggagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7763 - RNA, 1701 nt, Artificial Sequence
  derived and/or modified CDS sequence (AUadapt) from InfluenzaA__AEO01435__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccguguacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7764 - RNA, 1701 nt, Artificial Sequence; identical to SEQ ID NO: 7750
  derived and/or modified CDS sequence (AUadapt) from InfluenzaA__AEO01436__HA

SEQ ID NO: 7765 - RNA, 1701 nt, Artificial Sequence; identical to SEQ ID NO: 7632
  derived and/or modified CDS sequence (AUadapt) from InfluenzaA__AEO01437__HA

SEQ ID NO: 7766 - RNA, 1701 nt, Artificial Sequence; identical to SEQ ID NO: 7683
  derived and/or modified CDS sequence (AUadapt) from InfluenzaA__AEO01438__HA

SEQ ID NO: 7767 - RNA, 1701 nt, Artificial Sequence; identical to SEQ ID NO: 3267
  derived and/or modified CDS sequence (AUadapt) from InfluenzaA__AEO01440__HA

SEQ ID NO: 7768 - RNA, 1701 nt, Artificial Sequence
  derived and/or modified CDS sequence (AUadapt) from InfluenzaA__AEO01441__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgacggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7769 - RNA, 1701 nt, Artificial Sequence; identical to SEQ ID NO: 4334
  derived and/or modified CDS sequence (AUadapt) from InfluenzaA__AEO01442__HA

SEQ ID NO: 7770 - RNA, 1701 nt, Artificial Sequence
  derived and/or modified CDS sequence (AUadapt) from InfluenzaA__AEO01443__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggagaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 7771 - RNA, 1701 nt, Artificial Sequence
  derived and/or modified CDS sequence (AUadapt) from InfluenzaA__AEO01444__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucgguguccagcuucgagcgcuucgagaucuuccccaagaccuccucguggcccaaccacgacuccgacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7772 - RNA, 1701 nt, Artificial Sequence; identical to SEQ ID NO: 5082
  derived and/or modified CDS sequence (AUadapt) from InfluenzaA__AEO01445__HA

SEQ ID NO: 7773 - RNA, 1701 nt, Artificial Sequence; identical to SEQ ID NO: 7632
  derived and/or modified CDS sequence (AUadapt) from InfluenzaA__AEO01446__HA

SEQ ID NO: 7774 - RNA, 1701 nt, Artificial Sequence
  derived and/or modified CDS sequence (AUadapt) from InfluenzaA__AEO01447__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccaucgccucgagccugguccucguggugucccugggggccaucucguucuggaugugcuccaacggcagccugcagugccggaucugcaucuga

SEQ ID NO: 7775 - RNA, 1701 nt, Artificial Sequence; identical to SEQ ID NO: 3267
  derived and/or modified CDS sequence (AUadapt) from InfluenzaA__AEO01448__HA

SEQ ID NO: 7776 - RNA, 1701 nt, Artificial Sequence; identical to SEQ ID NO: 7750
  derived and/or modified CDS sequence (AUadapt) from InfluenzaA__AEO01449__HA

SEQ ID NO: 7777 - RNA, 1701 nt, Artificial Sequence
  derived and/or modified CDS sequence (AUadapt) from InfluenzaA__AEO01450__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccacggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagcacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7778 - RNA, 1701 nt, Artificial Sequence; identical to SEQ ID NO: 116
  derived and/or modified CDS sequence (AUadapt) from InfluenzaA__AEO01451__HA

SEQ ID NO: 7779 - RNA, 1701 nt, Artificial Sequence
  derived and/or modified CDS sequence (AUadapt) from InfluenzaA__AEO01452__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccgaggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucucggacacgcccgcccacgacugcaacacgaccugccagaccccgaagggcgcgaucaacaccucccugcccuuccagaacauccaccccaucaccaucggcaagugccccaaguacgucaagagcaccaagcugcggcucgccaccgggcugcgcaacgugccguccauccagucgcggggccuguucggggccaucgccggcuucaucgagggcggguggacgggcaugguggacgggugguacggcuaccaccaccagaacgagcagggguccggcuacgccgcggaccucaagucgacccagaacgccaucgacgagaucaccaacaaggugaacuccgugaucgagaagaugaacacccaguucacggccgucgggaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaagcucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggcgaagcugaaccgggaggagaucgacggggugaagcucgagagcacccgcaucuaccagauccuggccaucuacuccaccguggccucgagccugguccucguggugucccugggcgccaucucguucuggaugugcuccaacgggagccugcagugccggaucugcaucuga

SEQ ID NO: 7780 - RNA, 1701 nt, Artificial Sequence
  derived and/or modified CDS sequence (AUadapt) from InfluenzaA__AEO01453__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucuggggcgugcaccaccccagcaccuccgccgaccagcagucgcuguaccagaacgccgacgccuacguguucgucggcaccucccgguacagcaagaaguucaagcgcgagaucgccauccggcccaaggugcgcgaccaggagggccggaugaacuacuacuggacgcugguggagccgggggacaagaucaccuucgaggcgaccggcaaccucgucgugccccgcuacgccuucgccauggagcggaacgccggguccggcaucaucaucucggacacccccgugcacgacugcaacacgaccugccagacccccaagggcgccaucaacaccucccugccguuccagaacauccaccccaucacgaucgggaagugccccaaguacgucaagagcaccaagcugcgccucgcgaccggccugcggaacgugcccuccauccagucgcgcgggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggucaacuccgugaucgagaagaugaacacccaguucaccgccgucggcaaggaguucaaccaccuggagaagcggaucgagaaccugaacaagaagguggacgacggcuuccucgacaucuggacguacaacgccgagcugcuggugcuccuggagaacgagcgcacccuggacuaccacgacucgaacgucaagaaccucuacgagaaggugcggucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgcgaggagaucaacggcgucaagcucgagucgacccggaucuaccagauccuggcgaucuacuccaccguggccagcucgcuggugcucgucgugucccugggggccaucagcuucuggaugugcuccaacggcagccugcagugccgcaucugcaucuga

SEQ ID NO: 7781 - RNA, 1701 nt, Artificial Sequence
  derived and/or modified CDS sequence (AUadapt) from InfluenzaA__AEO01454__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaccaccaucgggaagugccccaaguacgucaagagcaccaagcugcggcuggcgacgggccuccgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 7782 - RNA, 1701 nt, Artificial Sequence
  derived and/or modified CDS sequence (AUadapt) from InfluenzaA__AEO01455__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7783 - RNA, 1701 nt, Artificial Sequence
  derived and/or modified CDS sequence (AUadapt) from InfluenzaA__AEO01456__HA
augaaggccauccugaucgugcuccuguacaccuucgccaccgcgaacgccgacacgcugugcaucggcuaccacgccaacaacucgaccgacaccgucgacacccuccuggagaagaacgugacggugacccacuccgucaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucguggagaccuccagcuccgacaacggcacgugcuaccccggcgacuucaucgacuacgaggagcugcgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccucaucuggcuggugaagaaggggaacucguaccccaagcuguccaagagcuacaucaacgacaagggcaaggagguccucgugcugugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccucguggagcccggggacaagaucaccuucgaggcgaccggcaaccuggucgugccccgguacgccuucgccauggaccgcaacgccggguccggcaucaucaucagcgacgcccccgugcacgacugcaacacgaccugccagaccccgaagggcgcgaucaacaccucccugcccuuccagaacauccaccccaucacgaucgggaagugccccaaguacgucaagucgaccaagcuccggcuggccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggucaacuccgugaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgggaggagaucgacggcgucaagcuggagagcacccgcaucuaccagauccuggccaucuacuccaccguggccucgagccucgugcuggucgugucccugggggccaucucguucuggaugugcuccaacggcagccuccagugccggaucugcaucuga

SEQ ID NO: 7784 - RNA, 1701 nt, Artificial Sequence; identical to SEQ ID NO: 7683
  derived and/or modified CDS sequence (AUadapt) from InfluenzaA__AEO01457__HA

SEQ ID NO: 7785 - RNA, 1701 nt, Artificial Sequence; identical to SEQ ID NO: 7679
  derived and/or modified CDS sequence (AUadapt) from InfluenzaA__AEO01458__HA

SEQ ID NO: 7786 - RNA, 1701 nt, Artificial Sequence; identical to SEQ ID NO: 7679
  derived and/or modified CDS sequence (AUadapt) from InfluenzaA__AEO01459__HA

SEQ ID NO: 7787 - RNA, 1701 nt, Artificial Sequence; identical to SEQ ID NO: 4334
  derived and/or modified CDS sequence (AUadapt) from InfluenzaA__AEO01461__HA

SEQ ID NO: 7788 - RNA, 1701 nt, Artificial Sequence; identical to SEQ ID NO: 4015
  derived and/or modified CDS sequence (AUadapt) from InfluenzaA__AEO01462__HA

SEQ ID NO: 7789 - RNA, 1701 nt, Artificial Sequence; identical to SEQ ID NO: 3267
  derived and/or modified CDS sequence (AUadapt) from InfluenzaA__AEO01463__HA

SEQ ID NO: 7790 - RNA, 1701 nt, Artificial Sequence
  derived and/or modified CDS sequence (AUadapt) from InfluenzaA__AEO01464__HA
augaaggccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccucguccuggagcuacaucgucgagaccuccucguccgacaacggcacgugcuaccccggcgacuucaucgacuacgaggagcugcgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccucaucuggcuggucaagaaggggaacagcuaccccaagcuguccaagucguacaucaacgacaagggcaaggaggugcucgugcugugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggaccgcaacgccggguccggcaucaucaucucggacacguccguccacgacugcaacacgaccugccagacccccaagggcgccaucaacaccagccugccguuccagaacauccaccccaucaccaucgggaagugccccaaguacgugaaguccaccaagcuccggcuggcgaccggccugcgcaacgugcccucgauccagucccggggccucuucggggccaucgccggguucaucgagggcggcuggacggggauggucgacggcugguacggguaccaccaccagaacgagcagggcagcggguacgccgccgaccugaaguccacccagaacgcgaucgacgagaucaccaacaaggugaacucggugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuacccgaaguacucggaggaggccaagcucaaccgggaggagaucgacggcgugaagcuggaguccacccgcaucuaccagauccuggcgaucuacagcaccguggccucgucccucguccugguggugagccugggggccaucuccuucuggaugugcagcaacggcucccuccagugccggaucugcaucuga

SEQ ID NO: 7791 - RNA, 1701 nt, Artificial Sequence; identical to SEQ ID NO: 7770
  derived and/or modified CDS sequence (AUadapt) from InfluenzaA__AEO01465__HA

SEQ ID NO: 7792 - RNA, 1701 nt, Artificial Sequence; identical to SEQ ID NO: 4786
  derived and/or modified CDS sequence (AUadapt) from InfluenzaA__AEO01466__HA

SEQ ID NO: 7793 - RNA, 1701 nt, Artificial Sequence; identical to SEQ ID NO: 3267
  derived and/or modified CDS sequence (AUadapt) from InfluenzaA__AEO01467__HA

SEQ ID NO: 7794 - RNA, 1701 nt, Artificial Sequence; identical to SEQ ID NO: 4078
  derived and/or modified CDS sequence (AUadapt) from InfluenzaA__AEO01468__HA

SEQ ID NO: 7795 - RNA, 1701 nt, Artificial Sequence; identical to SEQ ID NO: 116
  derived and/or modified CDS sequence (AUadapt) from InfluenzaA__AEO01469__HA

SEQ ID NO: 7796 - RNA, 1701 nt, Artificial Sequence
  derived and/or modified CDS sequence (AUadapt) from InfluenzaA__AEO01470__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucgugaucccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 7797 - RNA, 1701 nt, Artificial Sequence; identical to SEQ ID NO: 7623
  derived and/or modified CDS sequence (AUadapt) from InfluenzaA__AEO01471__HA

SEQ ID NO: 7798 - RNA, 1701 nt, Artificial Sequence; identical to SEQ ID NO: 4541
  derived and/or modified CDS sequence (AUadapt) from InfluenzaA__AEO01472__HA

SEQ ID NO: 7799 - RNA, 1701 nt, Artificial Sequence
  derived and/or modified CDS sequence (AUadapt) from InfluenzaA__AEO01473__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccggagggcgccaucaacaccucgcugcccuuccagaacauccaccccaucaccaucggggagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7800 - RNA, 1701 nt, Artificial Sequence
  derived and/or modified CDS sequence (AUadapt) from InfluenzaA__AEO01474__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcgacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7801 - RNA, 1701 nt, Artificial Sequence
  derived and/or modified CDS sequence (AUadapt) from InfluenzaA__AEO01475__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagcacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7802 - RNA, 1701 nt, Artificial Sequence
  derived and/or modified CDS sequence (AUadapt) from InfluenzaA__AEO01476__HA
augaaggccauccuggugguccuccuguacaccuucucgaccgccaacgcggacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugucgaccgccuccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 7803 - RNA, 1701 nt, Artificial Sequence
  derived and/or modified CDS sequence (AUadapt) from InfluenzaA__AEO01477__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacgccuucgugggcacgucccgguacagcaagaaguucaagcccgagaucgcgauccgcccgaaggugcgggagcaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 7804 - RNA, 1701 nt, Artificial Sequence; identical to SEQ ID NO: 4242
  derived and/or modified CDS sequence (AUadapt) from InfluenzaA__AEO01478__HA

SEQ ID NO: 7805 - RNA, 1701 nt, Artificial Sequence; identical to SEQ ID NO: 7632
  derived and/or modified CDS sequence (AUadapt) from InfluenzaA__AEO01479__HA

SEQ ID NO: 7806 - RNA, 1701 nt, Artificial Sequence; identical to SEQ ID NO: 7679
  derived and/or modified CDS sequence (AUadapt) from InfluenzaA__AEO01480__HA

SEQ ID NO: 7807 - RNA, 1701 nt, Artificial Sequence
  derived and/or modified CDS sequence (AUadapt) from InfluenzaA__AEO01482__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcaacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7808 - RNA, 1701 nt, Artificial Sequence
  derived and/or modified CDS sequence (AUadapt) from InfluenzaA__AEO01483__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucgguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgccgccuccagccugguccucguggugucgcugggggccaucuccuucuggaugugcagcaacggcucccugcagugccggaucugcaucuga

SEQ ID NO: 7809 - RNA, 1701 nt, Artificial Sequence
  derived and/or modified CDS sequence (AUadapt) from InfluenzaA__AEO01484__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcgacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7810 - RNA, 1701 nt, Artificial Sequence
  derived and/or modified CDS sequence (AUadapt) from InfluenzaA__AEO01485__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucaccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 7811 - RNA, 1701 nt, Artificial Sequence
  derived and/or modified CDS sequence (AUadapt) from InfluenzaA__AEO01487__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugacccucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7812 - RNA, 1701 nt, Artificial Sequence
  derived and/or modified CDS sequence (AUadapt) from InfluenzaA__AEO01488__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacggcaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgcgucgagccuggugcucguggucucccugggcgccaucucguucuggaugugcuccaacggcagccugcagugccggaucugcaucuga

SEQ ID NO: 7813 - RNA, 1701 nt, Artificial Sequence
  derived and/or modified CDS sequence (AUadapt) from InfluenzaA__AEO01489__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguuccgccccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7814 - RNA, 1701 nt, Artificial Sequence
  derived and/or modified CDS sequence (AUadapt) from InfluenzaA__AEO01490__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacucgaacgugaagaaccuguacgagaagguccgcaaccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacucgaccgucgccuccagccuggugcugguggucucgcucggggccaucuccuucuggaugugcagcaacggcucccugcagugccggaucugcaucuga

SEQ ID NO: 7815 - RNA, 1701 nt, Artificial Sequence
  derived and/or modified CDS sequence (AUadapt) from InfluenzaA__AEO01491__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaaguacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7816 - RNA, 1701 nt, Artificial Sequence; identical to SEQ ID NO: 7683
  derived and/or modified CDS sequence (AUadapt) from InfluenzaA__AEO01492__HA

SEQ ID NO: 7817 - RNA, 1701 nt, Artificial Sequence
  derived and/or modified CDS sequence (AUadapt) from InfluenzaA__AEO01493__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcuccgccgggucgggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggcgaccggccuccgcaacgucccgucgauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 7818 - RNA, 1701 nt, Artificial Sequence
  derived and/or modified CDS sequence (AUadapt) from InfluenzaA__AEO01494__HA
augaaggccauccuggugguccuccuguacaccuucgccaccgcgaacgccgacacgcugugcaccggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugucguccuucgagcgcuucgagaucuuccccaagaccagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcacguccgccgaccagcagucgcuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7819 - RNA, 1701 nt, Artificial Sequence; identical to SEQ ID NO: 4511
  derived and/or modified CDS sequence (AUadapt) from InfluenzaA__AEO01496__HA

SEQ ID NO: 7820 - RNA, 1701 nt, Artificial Sequence; identical to SEQ ID NO: 3267
  derived and/or modified CDS sequence (AUadapt) from InfluenzaA__AEO01497__HA

SEQ ID NO: 7821 - RNA, 1701 nt, Artificial Sequence; identical to SEQ ID NO: 4511
  derived and/or modified CDS sequence (AUadapt) from InfluenzaA__AEO01498__HA

SEQ ID NO: 7822 - RNA, 1701 nt, Artificial Sequence
  derived and/or modified CDS sequence (AUadapt) from InfluenzaA__AEO01499__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccuacaccagcgccgaccagcagucccuguaccagaacgccgacgccuacguguucgugggcaccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagcacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucaacggcgugaagcucgaguccacccgcaucuaccagauccuggcgaucuacagcaccgucgccuccucgcuggugcucguggucagccugggggccaucuccuucuggaugugcagcaacggcucccugcagugccggaucugcaucuga

SEQ ID NO: 7823 - RNA, 1701 nt, Artificial Sequence; identical to SEQ ID NO: 4015
  derived and/or modified CDS sequence (AUadapt) from InfluenzaA__AEO01500__HA

SEQ ID NO: 7824 - RNA, 1701 nt, Artificial Sequence; identical to SEQ ID NO: 4078
  derived and/or modified CDS sequence (AUadapt) from InfluenzaA__AEO01501__HA

SEQ ID NO: 7825 - RNA, 1701 nt, Artificial Sequence; identical to SEQ ID NO: 4078
  derived and/or modified CDS sequence (AUadapt) from InfluenzaA__AEO01502__HA

SEQ ID NO: 7826 - RNA, 1701 nt, Artificial Sequence; identical to SEQ ID NO: 4334
  derived and/or modified CDS sequence (AUadapt) from InfluenzaA__AEO01503__HA

SEQ ID NO: 7827 - RNA, 1701 nt, Artificial Sequence; identical to SEQ ID NO: 4511
  derived and/or modified CDS sequence (AUadapt) from InfluenzaA__AEO01505__HA

SEQ ID NO: 7828 - RNA, 1701 nt, Artificial Sequence; identical to SEQ ID NO: 4015
  derived and/or modified CDS sequence (AUadapt) from InfluenzaA__AEO01506__HA

SEQ ID NO: 7829 - RNA, 1701 nt, Artificial Sequence; identical to SEQ ID NO: 7623
  derived and/or modified CDS sequence (AUadapt) from InfluenzaA__AEO01507__HA

SEQ ID NO: 7830 - RNA, 1701 nt, Artificial Sequence; identical to SEQ ID NO: 4511
  derived and/or modified CDS sequence (AUadapt) from InfluenzaA__AEO01508__HA

SEQ ID NO: 7831 - RNA, 1701 nt, Artificial Sequence; identical to SEQ ID NO: 4242
  derived and/or modified CDS sequence (AUadapt) from InfluenzaA__AEO01510__HA

SEQ ID NO: 7832 - RNA, 1701 nt, Artificial Sequence
  derived and/or modified CDS sequence (AUadapt) from InfluenzaA__AEO01511__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccaccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucacggccgcgugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgcggacgccuacguguucgugggcaccucccgguacucgaagaaguucaagcccgagaucgccauccgcccgaagguccgggagcaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgagccuggugcucguggucucccugggggcgaucucguucuggaugugcuccaacggcagccugcagugccggaucugcaucuga

SEQ ID NO: 7833 - RNA, 1701 nt, Artificial Sequence
  derived and/or modified CDS sequence (AUadapt) from InfluenzaA__AEO01512__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacaagugcauggagucggugaagaacgggaccuacgacuaccccaaguacuccgaggaggccaagcugaaccgggaggagaucgacggcgugaagcucgagagcacgcgcaucuaccagauccuggcgaucuacuccaccgucgccucgagccuggugcucguggucucccugggggccaucucguucuggaugugcuccaacggcagccugcagugccggaucugcaucuga

SEQ ID NO: 7834 - RNA, 1701 nt, Artificial Sequence
  derived and/or modified CDS sequence (AUadapt) from InfluenzaA__AEO01513__HA
augaaggccauccuggccgugcuccuguacaccuucgcgaccgccaacgccgacacgcugugcaucggcuaccacgccaacaacucgaccgacaccgucgacaccgugcucgagaagaacgugacggucacccacuccgugaacauccuggaggacaagcacaacgggaagcugugcaagcuccgcggcguggcgccccugcaccuggggaagugcaacaucgccggcuggauccucgggaacccggagugcgagucgcuguccaccgccagcuccuggucguacaucgucgagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggugaccgccgccugcccgcacgcgggcgccaaguccuucuacaagaaccugaucuggcuggucaagaaggggaacucguaccccaagcucuccaagagcuacaucaacgacaagggcaaggaggugcuggugcugugggggauccaccaccccucgaccuccgccgaccagcagagccucuaccagaacgccgacgccuacgucuucgugggcuccucgcgguacuccaagaaguucaagcccgagaucgcgauccgcccgaaggugcgggaccaggagggccgcaugaacuacuacuggacgcuggucgagcccggggacaagaucaccuucgaggccaccggcaaccugguggugccccgguacgccuucgccauggagcgcaacgccgggagcggcaucaucaucuccgacacccccguccacgacugcaacacgaccugccagaccccgaagggcgcgaucaacaccucgcuccccuuccagaacauccaccccgugacgaucgggaagugccccaaguacgugaaguccaccaagcugcggcuggccaccggccuccgcaacgucccgagcauccagucccgggggcuguucggcgccaucgccggguucaucgagggcggcuggaccgggaugguggacggcugguacggguaccaccaccagaacgagcagggcucgggguacgccgcggaccugaaguccacgcagaacgccaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcuggaguccacccgcaucuaccagauccucgccaucuacucgaccgucgccagcucccuggugcugguggucucgcucggggccaucuccuucuggaugugcagcaacggcucccugcagugccggaucugcaucuga

SEQ ID NO: 7835 - RNA, 1701 nt, Artificial Sequence
  derived and/or modified CDS sequence (AUadapt) from InfluenzaA__AEO01514__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaugcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 7836 - RNA, 1701 nt, Artificial Sequence; identical to SEQ ID NO: 5101
  derived and/or modified CDS sequence (AUadapt) from InfluenzaA__AEO01515__HA

SEQ ID NO: 7837 - RNA, 1701 nt, Artificial Sequence; identical to SEQ ID NO: 7683
  derived and/or modified CDS sequence (AUadapt) from InfluenzaA__AEO01516__HA

SEQ ID NO: 7838 - RNA, 1701 nt, Artificial Sequence
  derived and/or modified CDS sequence (AUadapt) from InfluenzaA__AEO01517__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggagaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccggagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 7839 - RNA, 1701 nt, Artificial Sequence
  derived and/or modified CDS sequence (AUadapt) from InfluenzaA__AEO01518__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggaucgugaagaaggggaacucguaccccaagcucaacaaguccuacaucaacgacaagggcaaggaggugcugguccugugggggauccaccaccccagcaccucggccgaccagcagucccucuaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcuccccuuccagaacauccaccccaucaccaucggggagugccccaaguacgugaaguccaccaagcugcggcuggcgaccggccuccgcaacgucccgagcauccagucccgggggcuguucggcgccaucgccggguucaucgagggcggcuggacggggaugguggacggcugguacggguaccaccaccagaacgagcagggcucgggguacgccgccgaccugaaguccacccagaacgcgaucgacaagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacucgaccgucgccuccagccuggugcugguggucucgcucggggccaucuccuucuggaugugcagcaacggcucccugcagugccggaucugcaucuga

SEQ ID NO: 7840 - RNA, 1701 nt, Artificial Sequence
  derived and/or modified CDS sequence (AUadapt) from InfluenzaA__AEO01519__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguuccgccccgagaucgccauccggccgaagguccgcgagcaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 7841 - RNA, 1701 nt, Artificial Sequence; identical to SEQ ID NO: 5819
  derived and/or modified CDS sequence (AUadapt) from InfluenzaA__AEO01520__HA

SEQ ID NO: 7842 - RNA, 1701 nt, Artificial Sequence; identical to SEQ ID NO: 4541
  derived and/or modified CDS sequence (AUadapt) from InfluenzaA__AEO01521__HA

SEQ ID NO: 7843 - RNA, 1701 nt, Artificial Sequence; identical to SEQ ID NO: 6333
  derived and/or modified CDS sequence (AUadapt) from InfluenzaA__AEO01522__HA

SEQ ID NO: 7844 - RNA, 1701 nt, Artificial Sequence; identical to SEQ ID NO: 4078
  derived and/or modified CDS sequence (AUadapt) from InfluenzaA__AEO01523__HA

SEQ ID NO: 7845 - RNA, 1701 nt, Artificial Sequence; identical to SEQ ID NO: 7672
  derived and/or modified CDS sequence (AUadapt) from InfluenzaA__AEO01524__HA

SEQ ID NO: 7846 - RNA, 1701 nt, Artificial Sequence
  derived and/or modified CDS sequence (AUadapt) from InfluenzaA__AEO01525__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguacccccggcuguccaagagcuacaucaacgacaaggggaaggaggugcugguccucuggggcauccaccaccccucgaccuccgccgaccagcagagccuguaccagaacgccgacgccuacguguucgugggcacgucccgcuacucgaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 7847 - RNA, 1701 nt, Artificial Sequence; identical to SEQ ID NO: 4078
  derived and/or modified CDS sequence (AUadapt) from InfluenzaA__AEO01526__HA

SEQ ID NO: 7848 - RNA, 1701 nt, Artificial Sequence; identical to SEQ ID NO: 6855
  derived and/or modified CDS sequence (AUadapt) from InfluenzaA__AEO01527__HA

SEQ ID NO: 7849 - RNA, 1701 nt, Artificial Sequence
  derived and/or modified CDS sequence (AUadapt) from InfluenzaA__AEO01529__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggagaagaucgacggcgucaagcuggaguccacccgcaucuaccagauccucgcgaucuacucgaccgccgccagcucccuggugcugguggucucgcucggggccaucuccuucuggaugugcagcaacggcucccugcagugccggaucugcaucuga

SEQ ID NO: 7850 - RNA, 1701 nt, Artificial Sequence; identical to SEQ ID NO: 4078
  derived and/or modified CDS sequence (AUadapt) from InfluenzaA__AEO01530__HA

SEQ ID NO: 7851 - RNA, 1701 nt, Artificial Sequence
  derived and/or modified CDS sequence (AUadapt) from InfluenzaA__AEO01531__HA
augaaggccauccuggugguccuccuguacaccuucgccaccgcgaacacggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcgucuaccagauccuggccaucuacuccaccguggcgucgagccuggugcucgucgugucccugggggccaucucguucuggaugugcuccaacggcagccugcagugccggaucugcaucuga

SEQ ID NO: 7852 - RNA, 1701 nt, Artificial Sequence; identical to SEQ ID NO: 7683
  derived and/or modified CDS sequence (AUadapt) from InfluenzaA__AEO01532__HA

SEQ ID NO: 7853 - RNA, 1701 nt, Artificial Sequence
  derived and/or modified CDS sequence (AUadapt) from InfluenzaA__AEO01533__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7854 - RNA, 1701 nt, Artificial Sequence
  derived and/or modified CDS sequence (AUadapt) from InfluenzaA__AEO01534__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgcggagcugguccuacaucguggagaccucguccagcgacaacggcacgugcuaccccggcgacuucaucgacuacgaggagcuccgcgagcagcuguccucgguguccagcuucgagcgguucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcucgggguacgccgccgaccucaaguccacccagcacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 7855 - RNA, 1701 nt, Artificial Sequence; identical to SEQ ID NO: 4563
  derived and/or modified CDS sequence (AUadapt) from InfluenzaA__AEO01535__HA

SEQ ID NO: 7856 - RNA, 1701 nt, Artificial Sequence; identical to SEQ ID NO: 4078
  derived and/or modified CDS sequence (AUadapt) from InfluenzaA__AEO01536__HA

SEQ ID NO: 7857 - RNA, 1701 nt, Artificial Sequence; identical to SEQ ID NO: 5819
  derived and/or modified CDS sequence (AUadapt) from InfluenzaA__AEO01537__HA

SEQ ID NO: 7858 - RNA, 1701 nt, Artificial Sequence
  derived and/or modified CDS sequence (AUadapt) from InfluenzaA__AEO01538__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgcgagcagcugucguccgugagcuccuucgagcgguucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgcuacucgaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 7859 - RNA, 1701 nt, Artificial Sequence; identical to SEQ ID NO: 4541
  derived and/or modified CDS sequence (AUadapt) from InfluenzaA__AEO01539__HA

SEQ ID NO: 7860 - RNA, 1701 nt, Artificial Sequence
  derived and/or modified CDS sequence (AUadapt) from InfluenzaA__AEO01540__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgagaagcucugcaagcugcgcggggucgcgccccugcaccucggcaagugcaacaucgccggguggauccugggcaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucguggggaccucccgguacagcaagaaguucaagcccgagaucgccauccgcccgaagguccgggaccaggagggccgcaugaacuacuacuggacgcugguggagcccggcgacaagaucaccuucgaggcgaccgggaaccucguggucccccgguacgccuucgccauggagcgcaacgccggcuccgggaucaucaucucggacacccccgugcacgacugcaacacgaccugccagaccccgaagggcgccaucaacaccucccugcccuuccagaacauccaccccaucacgaucggcaagugccccaaguacgucaagagcaccaagcugcggcucgcgaccgggcugcgcaacgugccguccauccagucgcggggccuguucggggccaucgccggcuucaucgagggcggguggaccggcaugguggacgggugguacggcuaccaccaccagaacgagcagggguccggcuacgccgccgaccucaagagcacgcagcacgcgaucgacgagaucaccaacaaggugaacuccgucaucgagaagaugaacacccaguucaccgccguggggaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucaacggggugaagcucgagucgacccgcaucuaccagauccuggcgaucuacuccaccgucgccagcucgcuggugcucguggucucccugggcgccaucagcuucuggaugugcuccaacgggagccugcagugccggaucugcaucuga

SEQ ID NO: 7861 - RNA, 1701 nt, Artificial Sequence; identical to SEQ ID NO: 4334
  derived and/or modified CDS sequence (AUadapt) from InfluenzaA__AEO01541__HA

SEQ ID NO: 7862 - RNA, 1701 nt, Artificial Sequence; identical to SEQ ID NO: 4078
  derived and/or modified CDS sequence (AUadapt) from InfluenzaA__AEO01542__HA

SEQ ID NO: 7863 - RNA, 1701 nt, Artificial Sequence; identical to SEQ ID NO: 4015
  derived and/or modified CDS sequence (AUadapt) from InfluenzaA__AEO01543__HA

SEQ ID NO: 7864 - RNA, 1701 nt, Artificial Sequence; identical to SEQ ID NO: 4015
  derived and/or modified CDS sequence (AUadapt) from InfluenzaA__AEO01544__HA

SEQ ID NO: 7865 - RNA, 1701 nt, Artificial Sequence
  derived and/or modified CDS sequence (AUadapt) from InfluenzaA__AEO01545__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacagcgggaagcucugcaagcugcgcggcgucgcgccccugcaccucgggaagugcaacaucgccggcuggauccuggggaacccggagugcgagucccugucgaccgcguccagcugguccuacaucguggagaccucguccagcgacaacggcacgugcuaccccggcgacuucguggacuacgaggagcuccgggagcagcuguccucggucuccagcuucgagcgcuucgagaucuuccccaagaccuccucguggcccaaccacgacuccaacaagggggugaccgccgccugcccgcacgccggcgccaagagcuucuacaagaaccugaucuggcucgugaagaaggggaacuccuaccccaagcugucgaagagcuacaucaacgacaagggcaaggagguccuggugcucugggggauccaccaccccuccaccucggccgaccagcagucccuguaccagaacgccgacgccuacguguucgucggcacgagccgguacuccaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcugcggcucgcgaccggccugcgcaacgugccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggucaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 7866 - RNA, 1701 nt, Artificial Sequence; identical to SEQ ID NO: 62
  derived and/or modified CDS sequence (AUadapt) from InfluenzaA__AEO01546__HA

SEQ ID NO: 7867 - RNA, 1701 nt, Artificial Sequence; identical to SEQ ID NO: 62
  derived and/or modified CDS sequence (AUadapt) from InfluenzaA__AEO01547__HA

SEQ ID NO: 7868 - RNA, 1701 nt, Artificial Sequence; identical to SEQ ID NO: 96
  derived and/or modified CDS sequence (AUadapt) from InfluenzaA__AEO01548__HA

SEQ ID NO: 7869 - RNA, 1701 nt, Artificial Sequence; identical to SEQ ID NO: 3005
  derived and/or modified CDS sequence (AUadapt) from InfluenzaA__AEO01549__HA

SEQ ID NO: 7870 - RNA, 1701 nt, Artificial Sequence; identical to SEQ ID NO: 116
  derived and/or modified CDS sequence (AUadapt) from InfluenzaA__AEO01550__HA

SEQ ID NO: 7871 - RNA, 1701 nt, Artificial Sequence; identical to SEQ ID NO: 116
  derived and/or modified CDS sequence (AUadapt) from InfluenzaA__AEO01551__HA

SEQ ID NO: 7872 - RNA, 1701 nt, Artificial Sequence; identical to SEQ ID NO: 116
  derived and/or modified CDS sequence (AUadapt) from InfluenzaA__AEO01552__HA

SEQ ID NO: 7873 - RNA, 1701 nt, Artificial Sequence; identical to SEQ ID NO: 116
  derived and/or modified CDS sequence (AUadapt) from InfluenzaA__AEO01553__HA

SEQ ID NO: 7874 - RNA, 1701 nt, Artificial Sequence; identical to SEQ ID NO: 116
  derived and/or modified CDS sequence (AUadapt) from InfluenzaA__AEO01554__HA

SEQ ID NO: 7875 - RNA, 1701 nt, Artificial Sequence; identical to SEQ ID NO: 96
  derived and/or modified CDS sequence (AUadapt) from InfluenzaA__AEO01555__HA

SEQ ID NO: 7876 - RNA, 1701 nt, Artificial Sequence; identical to SEQ ID NO: 116
  derived and/or modified CDS sequence (AUadapt) from InfluenzaA__AEO01557__HA

SEQ ID NO: 7877 - RNA, 1701 nt, Artificial Sequence; identical to SEQ ID NO: 116
  derived and/or modified CDS sequence (AUadapt) from InfluenzaA__AEO01558__HA

SEQ ID NO: 7878 - RNA, 1701 nt, Artificial Sequence
  derived and/or modified CDS sequence (AUadapt) from InfluenzaA__AEO01559__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcaggacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 7879 - RNA, 1701 nt, Artificial Sequence; identical to SEQ ID NO: 116
  derived and/or modified CDS sequence (AUadapt) from InfluenzaA__AEO01560__HA

SEQ ID NO: 7880 - RNA, 1701 nt, Artificial Sequence; identical to SEQ ID NO: 116
  derived and/or modified CDS sequence (AUadapt) from InfluenzaA__AEO01561__HA

SEQ ID NO: 7881 - RNA, 1701 nt, Artificial Sequence; identical to SEQ ID NO: 116
  derived and/or modified CDS sequence (AUadapt) from InfluenzaA__AEO01562__HA

SEQ ID NO: 7882 - RNA, 1701 nt, Artificial Sequence; identical to SEQ ID NO: 116
  derived and/or modified CDS sequence (AUadapt) from InfluenzaA__AEO01563__HA

SEQ ID NO: 7883 - RNA, 1701 nt, Artificial Sequence; identical to SEQ ID NO: 116
  derived and/or modified CDS sequence (AUadapt) from InfluenzaA__AEO01564__HA

SEQ ID NO: 7884 - RNA, 1701 nt, Artificial Sequence; identical to SEQ ID NO: 116
  derived and/or modified CDS sequence (AUadapt) from InfluenzaA__AEO01565__HA

SEQ ID NO: 7885 - RNA, 1701 nt, Artificial Sequence; identical to SEQ ID NO: 62
  derived and/or modified CDS sequence (AUadapt) from InfluenzaA__AEO01566__HA

SEQ ID NO: 7886 - RNA, 1701 nt, Artificial Sequence; identical to SEQ ID NO: 3156
  derived and/or modified CDS sequence (AUadapt) from InfluenzaA__AEO01567__HA

SEQ ID NO: 7887 - RNA, 1701 nt, Artificial Sequence; identical to SEQ ID NO: 3096
  derived and/or modified CDS sequence (AUadapt) from InfluenzaA__AEO01568__HA

SEQ ID NO: 7888 - RNA, 1701 nt, Artificial Sequence; identical to SEQ ID NO: 3096
  derived and/or modified CDS sequence (AUadapt) from InfluenzaA__AEO01569__HA

SEQ ID NO: 7889 - RNA, 1701 nt, Artificial Sequence; identical to SEQ ID NO: 3156
  derived and/or modified CDS sequence (AUadapt) from InfluenzaA__AEO01570__HA

SEQ ID NO: 7890 - RNA, 1701 nt, Artificial Sequence; identical to SEQ ID NO: 3096
  derived and/or modified CDS sequence (AUadapt) from InfluenzaA__AEO01571__HA

SEQ ID NO: 7891 - RNA, 1701 nt, Artificial Sequence; identical to SEQ ID NO: 3156
  derived and/or modified CDS sequence (AUadapt) from InfluenzaA__AEO01572__HA

SEQ ID NO: 7892 - RNA, 1701 nt, Artificial Sequence; identical to SEQ ID NO: 62
  derived and/or modified CDS sequence (AUadapt) from InfluenzaA__AEO01573__HA

SEQ ID NO: 7893 - RNA, 1701 nt, Artificial Sequence; identical to SEQ ID NO: 116
  derived and/or modified CDS sequence (AUadapt) from InfluenzaA__AEO01574__HA

SEQ ID NO: 7894 - RNA, 1701 nt, Artificial Sequence; identical to SEQ ID NO: 62
  derived and/or modified CDS sequence (AUadapt) from InfluenzaA__AEO01575__HA

SEQ ID NO: 7895 - RNA, 1701 nt, Artificial Sequence; identical to SEQ ID NO: 62
  derived and/or modified CDS sequence (AUadapt) from InfluenzaA__AEO01576__HA

SEQ ID NO: 7896 - RNA, 1701 nt, Artificial Sequence; identical to SEQ ID NO: 62
  derived and/or modified CDS sequence (AUadapt) from InfluenzaA__AEO01577__HA

SEQ ID NO: 7897 - RNA, 1701 nt, Artificial Sequence; identical to SEQ ID NO: 3156
  derived and/or modified CDS sequence (AUadapt) from InfluenzaA__AEO01578__HA

SEQ ID NO: 7898 - RNA, 1701 nt, Artificial Sequence; identical to SEQ ID NO: 3156
  derived and/or modified CDS sequence (AUadapt) from InfluenzaA__AEO01579__HA

SEQ ID NO: 7899 - RNA, 1701 nt, Artificial Sequence; identical to SEQ ID NO: 62
  derived and/or modified CDS sequence (AUadapt) from InfluenzaA__AEO01581__HA

SEQ ID NO: 7900 - RNA, 1701 nt, Artificial Sequence; identical to SEQ ID NO: 62
  derived and/or modified CDS sequence (AUadapt) from InfluenzaA__AEO01582__HA

SEQ ID NO: 7901 - RNA, 1701 nt, Artificial Sequence; identical to SEQ ID NO: 62
  derived and/or modified CDS sequence (AUadapt) from InfluenzaA__AEO01583__HA

SEQ ID NO: 7902 - RNA, 1701 nt, Artificial Sequence; identical to SEQ ID NO: 62
  derived and/or modified CDS sequence (AUadapt) from InfluenzaA__AEO01584__HA

SEQ ID NO: 7903 - RNA, 1701 nt, Artificial Sequence; identical to SEQ ID NO: 62
  derived and/or modified CDS sequence (AUadapt) from InfluenzaA__AEO01585__HA

SEQ ID NO: 7904 - RNA, 1701 nt, Artificial Sequence; identical to SEQ ID NO: 62
  derived and/or modified CDS sequence (AUadapt) from InfluenzaA__AEO01586__HA

SEQ ID NO: 7905 - RNA, 1701 nt, Artificial Sequence; identical to SEQ ID NO: 62
  derived and/or modified CDS sequence (AUadapt) from InfluenzaA__AEO01587__HA

SEQ ID NO: 7906 - RNA, 1701 nt, Artificial Sequence; identical to SEQ ID NO: 62
  derived and/or modified CDS sequence (AUadapt) from InfluenzaA__AEO01588__HA

SEQ ID NO: 7907 - RNA, 1701 nt, Artificial Sequence; identical to SEQ ID NO: 116
  derived and/or modified CDS sequence (AUadapt) from InfluenzaA__AEO01589__HA

SEQ ID NO: 7908 - RNA, 1701 nt, Artificial Sequence; identical to SEQ ID NO: 116
  derived and/or modified CDS sequence (AUadapt) from InfluenzaA__AEO01590__HA

SEQ ID NO: 7909 - RNA, 1701 nt, Artificial Sequence; identical to SEQ ID NO: 116
  derived and/or modified CDS sequence (AUadapt) from InfluenzaA__AEO01591__HA

SEQ ID NO: 7910 - RNA, 1701 nt, Artificial Sequence; identical to SEQ ID NO: 62
  derived and/or modified CDS sequence (AUadapt) from InfluenzaA__AEO01592__HA

SEQ ID NO: 7911 - RNA, 1701 nt, Artificial Sequence; identical to SEQ ID NO: 116
  derived and/or modified CDS sequence (AUadapt) from InfluenzaA__AEO01593__HA

SEQ ID NO: 7912 - RNA, 1701 nt, Artificial Sequence; identical to SEQ ID NO: 62
  derived and/or modified CDS sequence (AUadapt) from InfluenzaA__AEO01594__HA

SEQ ID NO: 7913 - RNA, 1701 nt, Artificial Sequence; identical to SEQ ID NO: 62
  derived and/or modified CDS sequence (AUadapt) from InfluenzaA__AEO01595__HA

SEQ ID NO: 7914 - RNA, 1701 nt, Artificial Sequence; identical to SEQ ID NO: 96
  derived and/or modified CDS sequence (AUadapt) from InfluenzaA__AEO01596__HA

SEQ ID NO: 7915 - RNA, 1701 nt, Artificial Sequence; identical to SEQ ID NO: 116
  derived and/or modified CDS sequence (AUadapt) from InfluenzaA__AEO01597__HA

SEQ ID NO: 7916 - RNA, 1701 nt, Artificial Sequence
  derived and/or modified CDS sequence (AUadapt) from InfluenzaA__AEO01598__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagauguuccccaagaccagcuccuggcccaaccacgacucgaacaacggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 7917 - RNA, 1701 nt, Artificial Sequence; identical to SEQ ID NO: 116
  derived and/or modified CDS sequence (AUadapt) from InfluenzaA__AEO01599__HA

SEQ ID NO: 7918 - RNA, 1701 nt, Artificial Sequence; identical to SEQ ID NO: 116
  derived and/or modified CDS sequence (AUadapt) from InfluenzaA__AEO01600__HA

SEQ ID NO: 7919 - RNA, 1701 nt, Artificial Sequence; identical to SEQ ID NO: 116
  derived and/or modified CDS sequence (AUadapt) from InfluenzaA__AEO01601__HA

SEQ ID NO: 7920 - RNA, 1701 nt, Artificial Sequence; identical to SEQ ID NO: 116
  derived and/or modified CDS sequence (AUadapt) from InfluenzaA__AEO01602__HA

SEQ ID NO: 7921 - RNA, 1701 nt, Artificial Sequence; identical to SEQ ID NO: 116
  derived and/or modified CDS sequence (AUadapt) from InfluenzaA__AEO01603__HA

SEQ ID NO: 7922 - RNA, 1701 nt, Artificial Sequence; identical to SEQ ID NO: 116
  derived and/or modified CDS sequence (AUadapt) from InfluenzaA__AEO01604__HA

SEQ ID NO: 7923 - RNA, 1701 nt, Artificial Sequence; identical to SEQ ID NO: 116
  derived and/or modified CDS sequence (AUadapt) from InfluenzaA__AEO01605__HA

SEQ ID NO: 7924 - RNA, 1701 nt, Artificial Sequence
  derived and/or modified CDS sequence (AUadapt) from InfluenzaA__AEO01606__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 7925 - RNA, 1701 nt, Artificial Sequence; identical to SEQ ID NO: 3156
  derived and/or modified CDS sequence (AUadapt) from InfluenzaA__AEO01607__HA

SEQ ID NO: 7926 - RNA, 1701 nt, Artificial Sequence; identical to SEQ ID NO: 5819
  derived and/or modified CDS sequence (AUadapt) from InfluenzaA__AEO01608__HA

SEQ ID NO: 7927 - RNA, 1701 nt, Artificial Sequence; identical to SEQ ID NO: 7679
  derived and/or modified CDS sequence (AUadapt) from InfluenzaA__AEO01609__HA

SEQ ID NO: 7928 - RNA, 1701 nt, Artificial Sequence
  derived and/or modified CDS sequence (AUadapt) from InfluenzaA__AEO01610__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagcacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccgggugugcaucuga

SEQ ID NO: 7929 - RNA, 1701 nt, Artificial Sequence
  derived and/or modified CDS sequence (AUadapt) from InfluenzaA__AEO01611__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggccgggaggugcugguccucugggggauccaccaccccagcaccuccgccgaccagcagucgcuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucggggagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgccgccucgagccugguccucguggugucccugggggccaucucguucuggaugugcuccaacggcagccugcagugccgcaucugcaucuga

SEQ ID NO: 7930 - RNA, 1701 nt, Artificial Sequence
  derived and/or modified CDS sequence (AUadapt) from InfluenzaA__AEO01612__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggccaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 7931 - RNA, 1701 nt, Artificial Sequence; identical to SEQ ID NO: 5511
  derived and/or modified CDS sequence (AUadapt) from InfluenzaA__AEO01613__HA

SEQ ID NO: 7932 - RNA, 1701 nt, Artificial Sequence
  derived and/or modified CDS sequence (AUadapt) from InfluenzaA__AEO01614__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 7933 - RNA, 1701 nt, Artificial Sequence
  derived and/or modified CDS sequence (AUadapt) from InfluenzaA__AEO01615__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaaguacuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 7934 - RNA, 1701 nt, Artificial Sequence; identical to SEQ ID NO: 3267
  derived and/or modified CDS sequence (AUadapt) from InfluenzaA__AEO01616__HA

SEQ ID NO: 7935 - RNA, 1701 nt, Artificial Sequence; identical to SEQ ID NO: 4078
  derived and/or modified CDS sequence (AUadapt) from InfluenzaA__AEO01617__HA

SEQ ID NO: 7936 - RNA, 1701 nt, Artificial Sequence; identical to SEQ ID NO: 4511
  derived and/or modified CDS sequence (AUadapt) from InfluenzaA__AEO01619__HA

SEQ ID NO: 7937 - RNA, 1701 nt, Artificial Sequence; identical to SEQ ID NO: 7623
  derived and/or modified CDS sequence (AUadapt) from InfluenzaA__AEO01620__HA

SEQ ID NO: 7938 - RNA, 1701 nt, Artificial Sequence; identical to SEQ ID NO: 7770
  derived and/or modified CDS sequence (AUadapt) from InfluenzaA__AEO01621__HA

SEQ ID NO: 7939 - RNA, 1701 nt, Artificial Sequence
  derived and/or modified CDS sequence (AUadapt) from InfluenzaA__AEO01625__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccaggugcucgacggcgagaacugcacccugaucgacgcccugcucggggacccccagugcgacggcuuccagaacaagaagugggaccuguucguggagcgcuccaaggccuacagcaacugcuaccccuacgacgucccggacuacgcgucccugcggucgcucguggccuccucgggcacgcuggaguucaacaacgaguccuucaacuggaccggggugacccagaacggcaccagcuccgccugcauccgccggucgaacaacuccuucuucagccgccugaacuggcucacgcacuccaaguucaaguaccccgcccugaacgucaccaugcccaacaacgaggaguucgacaagcuguacaucuggggcgugcaccaccccgggaccgacaacgaccagaucuuccucuacgcgcaggccucggggcggaucaccgugucgacgaagcgcucccagcagaccgucaucccgaacaucggcagccggccccgcgugcggaacauccccucccgcaucucgaucuacuggaccaucgugaagcccggcgacauccugcugaucaacuccaccgggaaccucaucgccccgcggggcuacuucaagauccgcagcgggaaguccucgaucaugcgguccgacgcccccaucggcaagugcaacucggagugcaucacgcccaacggcuccauccccaacgacaagccguuccagaacgucaaccgcaucaccuacggggccugcccccgguacgugaagcagaacacccugaagcuggcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccucaaguccacccaggcggccaucgaccagaucaacgggaagcugaaccggcugaucggcaagaccaacgagaaguuccaccagaucgagaaggaguucucggagguggagggccgcauccaggaccucgagaaguacguggaggacaccaagaucgaccugugguccuacaacgccgagcugcucgucgcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgagguguaccgcgacgaggcccugaacaaccgguuccagaucaaggggguggagcucaagucgggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 7940 - RNA, 1701 nt, Artificial Sequence
  derived and/or modified CDS sequence (AUadapt) from InfluenzaA__AEO01636__HA
augaaguccaucaucgcccuguccuacauccucugccuggugucggcccagaagcugcccggcaacgacaacuccaccgcgacccucugccuggggcaccacgccgucccgaacggcacgaucgugaagaccaucaccaacgaccagaucgaggugaccaacgccacggagcugguccagucguccagcaccggggagaucugcgacucgccccaccaggugcucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacccuggaguucaacaacgagucguucaacuggacgggggugacccagaacggcaccuccucggccugcauccgccgguccaacaacagcuucuucucccgccugaacuggcucacccacucgaaguucaaguaccccgcccugaacgucacgaugcccaacaacgaggaguucgacaagcuguacaucuggggcgugcaccaccccgggaccgacaacgaccagaucuuccucuacgcgcaggccagcgggcggaucaccguguccaccaagcgcucgcagcagacggucaucccgaacaucggcucccggccccgcgugcggaacauccccagccgcaucuccaucuacuggaccaucgugaagcccggcgacauccugcugaucaacucgaccgggaaccucaucgccccgcggggcuacuucaagauccgcuccggcaagucguccaucaugcggagcgacgcccccaucgggaagugcaacuccgagugcaucacccccaacggcucgauccccaacgacaagccguuccagaacgucaaccgcaucacguacggggccugcccccgguacgugaagcagaacacccugaagcuggcgaccggcaugcgcaacgugcccgagaagcagacccgggggaucuucggcgccaucgccggguucaucgagaacggcugggagggcauggucgacgggugguacggcuuccgccaccagaacuccgaggggaucggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggucguacaacgccgagcugcucgucgcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaaggggguggagcucaaguccggcuacaaggacuggauccuguggaucucguucgccaucagcugcuuccugcucugcgucgcccugcugggcuucaucaugugggccugccagaaggggaacauccgcugcaacaucugcaucuga

SEQ ID NO: 7941 - RNA, 1701 nt, Artificial Sequence
  derived and/or modified CDS sequence (AUadapt) from InfluenzaA__AEO01642__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcaacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaacaacuccuucuucagccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggucggacgcccccaucgggaagugcaacuccaagugcaucacgcccaacggcagcauccccaacgacaagccguuccagaacgugaaccgcgucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 7942 - RNA, 1698 nt, Artificial Sequence
  derived and/or modified CDS sequence (AUadapt) from InfluenzaA__AEO01663__HA
augaaggugaagcugcucguccugcugugcaccuucgccgccaccuacgcggacacgaucugcaucggcuaccacgccaacaacucgaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacaccgucacggggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccaacaucggcgaccagaaggcccuguaccacaccgagaacgccuacgugagcgucgugagcucccacuacucgcggaaguucacccccgagaucgcgaagcgccccaaggugcgggaccaggagggccgcaucaacuacuacuggacgcuccuggagcccggggacaccaucaucuucgaggccaacggcaaccugcgggccccgcgcuacgccuucgcccucucccggggguucggcagcggcaucaucaacuccaacgcgcccauggacaagugcgacgccaagugccagacgccccagggggccaucaacagcucccugcccuuccagaacguccacccggugcccaucggcgagugccccaaguacgugcgcucggccaagcugcggauggucaccgggcuccgcaacauccccuccauccagagccggggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuucaucgacaucuggaccuacaacgcggagcugcuggugcuccuggagaacgagcgcacccuggacuuccacgacucgaacgugaagaaccucuacgagaaggucaagucccagcugaagaacaacgccaaggagaucgggaacggcugcuucgaguucuaccacaagugcaacgacgagugcauggagagcgugaagaacgggaccuacgacuacccgaaguacuccgaggagagcaagcugaaccgggagaagaucgacggcgugcgccucgaguccaugggcgucuaccagauccuggccaucuacucgacgguggccagcucccuggugcuccuggucagccugggggccaucuccuucuggaugugcagcaacggcucccuccagugccggaucugcaucuga

SEQ ID NO: 7943 - RNA, 1698 nt, Artificial Sequence
  derived and/or modified CDS sequence (AUadapt) from InfluenzaA__AEO01674__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccaacaucggcgaccagaaggcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccaucaucuucgaggcgaacgagaaccugaaggccccgcgguacgccuucgcccucucccgcggcuucgggagcggcaucaucaacuccaaggcccccauggacaagugcgacgcgaagugccagacgccccagggcgccaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacucgaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugcggcucgaguccaugggcgucuaccagauccuggccaucuacucgaccguggccagcucccuggugcuccuggucagccugggcgccaucuccuucuggaugugcagcaacgggucccuccagugccgcaucugcaucuga

SEQ ID NO: 7944 - RNA, 1701 nt, Artificial Sequence; identical to SEQ ID NO: 7939
  derived and/or modified CDS sequence (AUadapt) from InfluenzaA__AEO01691__HA

SEQ ID NO: 7945 - RNA, 1698 nt, Artificial Sequence
  derived and/or modified CDS sequence (AUadapt) from InfluenzaA__AEO01699__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacucgcggaaguucacgcccgagaucgccaagcgccccaaggugcgggaccaggagggccgcaucaacuacuacuggacccuccuggagccccgggacaccaucaucuucgaggcgaacgggaaccugaucgccccgcgcuacgccuucgcccucucccggggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcgcucggccaagcugcggauggucaccggccuccgcaacauccccuccauccccagccgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacucggucaucgagaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuacccgaaguacuccgaggagucgaagcugaaccgggagaagaucgacggggugaagcucgaguccaugggcgccuaccagauccuggccaucuacagcaccggcgccucgucccugguccuccuggugagccugggggccaucuccuucuggaugugcagcaacggcucccuccagcgccggaucugcaucuga

SEQ ID NO: 7946 - RNA, 1698 nt, Artificial Sequence
  derived and/or modified CDS sequence (AUadapt) from InfluenzaA__AEO01709__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccaacaucggcgaccagaaggcccuguaccacaccgagaacgccuacgugagcgucgugagcucccacuacucgcggaaguucacgcccgagaucgccaagcgccccaagcuccgggaccaggacggccgcaucaacuacuacuggacccugcuggagcccggggacaccaccaucuucgaggcgaacggcaaccucaucgccccgcgguacgccuucgcccugucccgcggguucggcagcggcaucaucaacuccaacgcccccauggacaagugcgacgcgaagugccagacgccccagggggccaucaacagcucccugcccuuccagaacgugcacccggucaccaucggcgagugccccaaguacgugcggucggccaagcuccgcauggugaccgggcugcggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcucgagcggcgcauggagaaccugaacaagaagguggacgacggcuucaucgacaucuggacguacaacgccgagcugcucguccugcuggagaacgagcggacccucgacuuccacgacucgaacgugaagaaccuguacgagaaggugaagucccagcugaagaacaacgcgaaggagaucgggaacggcugcuucgagcucuaccugaagugcaacggggagugcauggagagcgucaagaacggcaccuacgacuaccccaaguacuccgaggagagcaagcugaaccgcgagaagaucgacggcgugaagcucgaguccauggggguguaccagauccuggccaucuacucgaccgucgccagcucccuggugcuccuggugagccugggcgccaucuccuucuggaugugcagcaacgggucccugcagugccggaucugcaucuga

SEQ ID NO: 7947 - RNA, 1701 nt, Artificial Sequence; identical to SEQ ID NO: 4078
  derived and/or modified CDS sequence (AUadapt) from InfluenzaA__AEO37530__HA

SEQ ID NO: 7948 - RNA, 1701 nt, Artificial Sequence
  derived and/or modified CDS sequence (AUadapt) from InfluenzaA__AEO72176__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgucgucccuggugcucgccgugagccugggggccaucucguucuggaugugcuccaacggcagccugcagugccggaucugcaucuga

SEQ ID NO: 7949 - RNA, 1704 nt, Artificial Sequence
  derived and/or modified CDS sequence (AUadapt) from InfluenzaA__AEO88980__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagucguccuggagcgaccacgaggccuccucgggcgucuccagcgcgugcccguaccagggcacccccuccuucuuccgcaacgugguguggcugaucaagaagaacaacacguaccccaccaucaagcggucguacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggucgaaggugaacgggcaguccggccgcauggacuucuucuggaccauccucaagcccaacgacgcgaucaacuucgagagcaacgggaacuucaucgcccccgaguacgccuacaagaucgucaagaagggcgacucggccaucaugaaguccgagguggaguacggcaacugcaacaccaagugccagaccccgaucggggccaucaacagcuccaugcccuuccacaacauccacccccugacgaucggcgagugccccaaguacgucaagucgaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagucgacccagaaggcgaucgacggcgugaccaacaaggucaacuccaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacucggaggaggcccgccucaagcgggaggagaucuccggggugaagcuggagagcaucggcacguaccagauccuguccaucuacucgaccgucgcguccagccucgcccuggccaucaugguggccgggcugucccucuggaugugcucgaacggcagccugcagugccgcaucugcaucuga

SEQ ID NO: 7950 - RNA, 1704 nt, Artificial Sequence
  derived and/or modified CDS sequence (AUadapt) from InfluenzaA__AEO89021__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagaucccgaucauccccaagagcuccuggucggaccacgaggccuccagcggcgucuccucggcgugccccuaccagggcacccccuccuucuuccgcaacgugguguggcugaucaagaagaacaacacguacccgaccaucaagcggagcuacaacaacaccaaccaggaggaccuccugauccugugggggauccaccacuccaacaacgccgccgagcagaccaagcucuaccagaaccccacgaccuacaucucggucggcaccuccacccugaaccugcgccucgugcccaagaucgccacgcggagcaaggugaacgggcaguccggccgcauggacuucuucuggaccauccugaagcccaacgacgcgaucaacuucgagucgaacgggaacuucaucgccccggaguacgccuacaagaucgucaagaagggcgacagcgccaucaugaaguccgagguggaguacggcaacugcaacaccaagugccagacccccaucggggccaucaacucguccaugcccuuccacaacauccacccccugacgaucggcgagugcccgaaguacgugaaguccaacaagcucguccuggcgaccgggcugcggaacagcccccuccgcgagcggcgccggaagcgcggccuguucggcgccaucgccggguucaucgagggcggguggcagggcaugguggacgggugguacggcuaccaccacucgaacgagcagggcuccggguacgccgccgacaaggagagcacccagaaggcgaucgacggcgugaccaacaaggucaacuccaucaucgacaagaugaacacgcaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacucgaacgugaagaaccucuacgacaagguccggcugcagcugcgcgacaacgccaaggagcucgggaacggcugcuucgaguucuaccacaagugcgacaacgagugcauggaguccgugcggaacggcaccuacgacuacccccaguacagcgaggaggcccgccugaagcgggaggagaucuccggggugaagcuggagucgaucggcacguaccagauccucuccaucuacagcaccgucgcguccucgcuggcccuggccaucaugguggccgggcucucccuguggaugugcagcaacggcagccugcagugccgcaucugcaucuga

SEQ ID NO: 7951 - RNA, 1704 nt, Artificial Sequence
  derived and/or modified CDS sequence (AUadapt) from InfluenzaA__AEO89030__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcgucuccucggugugcccguaccagggcacccccuccuucuuccgcaacguggucuggcugaucaagaagaacaacacguaccccaccaucaagcggagcuacaacaacaccaaccaggaggaccuccugauccugugggggauccaccacuccaacgacgcggccgagcagaccaagcucuaccagaacccgacgaccuacaucucggugggcaccuccacccugaaccagcgccuggugcccaagaucgccacgcggagcaaggucaacgggcaguccggccgcauggacuucuucuggaccgugcucaagcccaacgacgccaucaacuucgagucgaacgggaacuucaucgcgcccgaguacgccuacaagaucgugaagaagggcgacagcgccaucaugaaguccgaggucgaguacggcaacugcaacaccaagugccagaccccgaucggggccaucaacucguccaugcccuuccacaacauccacccccugacgaucggcgagugccccaaguacgucaagagcaacaagcuggugcucgccaccgggcugcggaacuccccgcugcgcgagcggcgccggaagcgcggccucuucggcgcgaucgccggguucaucgagggcggguggcagggcaugguggacgggugguacggcuaccaccacucgaacgagcagggcuccggguacgccgccgacaaggagagcacccagaaggccaucgacggcgugaccaacaaggugaacuccaucaucgacaagaugaacacgcaguucgaggcggucgggcgggaguucaacaaccuggagcgccggaucgagaaccugaacaagaagauggaggacggcuuccucgacguguggaccuacaacgccgagcugcugguccucauggagaacgagcgcacccuggacuuccacgacucgaacgugaagaaccuguacgacaaggugcggcuccagcugcgcgacaacgccaaggagcuggggaacggcugcuucgaguucuaccacaagugcgacaacgagugcauggaguccguccggaacggcaccuacgacuacccccaguacagcgaggaggcccgccucaagcgggaggagaucuccggggugaagcuggagucgaucggcacguaccagauccuguccaucuacagcaccguggccuccucgcucgcgcuggccaucauggucgccgggcugucccucuggaugugcagcaacggcagccugcagugccgcaucugcaucuga

SEQ ID NO: 7952 - RNA, 1704 nt, Artificial Sequence
  derived and/or modified CDS sequence (AUadapt) from InfluenzaA__AEO89048__HA
auggagaagaucguguuccugcucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgccaacgaccucugcuaccccgggaacuucaacgacuacgaggagcugaagcaccuccugucccggaucaaccacuucgagaagauccagaucauccccaagagcuccuggucggaccacgaggccuccagcggcgucuccucggcgugcccguaccagggcacccccuccuucuuccgcaacgugaucuggcugaucaagaagaacaacacguaccccaccaucaagcggagcuacaacaacaccaaccaggaggaccugcucauccugugggggauccaccacuccaacgacgccgccgagcagaccaagcuguaccagaacccgacgaccuacaucucggugggcaccuccacccucaaccagcgccugguccccaagaucgccacgcggagcaaggugaacgggcaguccggccgcauggacuucuucuggaccauccugaagcccaacgacgcgaucaacuucgagucgaacgggaacuucaucgcccccgaguacgccuacaagaucgugaagaagggcgacagcgccauccucaaguccgaggucgaguacggcaacugcaacaccaagugccagaccccgaucggggccaucaacucguccaugcccuuccacaacauccacccccugacgaucggcgagugccccaaguacgucaagagcaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacucgaacgagcagggcuccggguacgccgccgacaaggagagcacccagaaggcgaucgacggcgugaccaacaaggugaacuccaucaucgacaagaugaacacgcaguucgaggccgucgggcgggaguucaacaaccuggagcgccggaucgagaaccugaacaagaagauggaggacggcuuccucgacguguggaccuacaacgccgagcugcuggugcucauggagaacgagcgcacccuggacuuccacgacucgaacgucaagaaccuguacgacaaggugcggcuccagcugcgcgacaacgccaaggagcuggggaacggcugcuucgaguucuaccacaagugcgacaacgagugcauggaguccguccggaacggcaccuacgacuacccccaguacagcgaggaggcccgccucaagcgggaggagaucuccggggugaagcuggagucgaucggcacguaccagauccuguccaucuacagcaccguggcguccucgcucgcccuggccaucauggucgccgggcugucccucuggaugugcagcaacggcagccugcagugccgcaucugcaucuga

SEQ ID NO: 7953 - RNA, 1704 nt, Artificial Sequence
  derived and/or modified CDS sequence (AUadapt) from InfluenzaA__AEO89065__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccucgggcgucuccagcgugugcccguaccagggcacccccuccuucuuccgcaacguggucuggcugaucaagaagaacaacacguaccccaccaucaagcggucguacaacaacaccaaccaggaggaccuccugauccugugggggauccaccacuccaacgacgcggccgagcagaccaagcucuaccagaacccgacgaccuacaucagcgugggcaccuccacccugaaccugcgccucgugcccaagaucgccacgcggagcaaggucaacgggcaguccggccgcauggacuucuucuggaccauccugaagcccucggacgccaucaacuucgagagcaacgggaacuucaucgcgcccgaguacgccuacaagaucgugaagaagggcgacuccgccaucaugaaguccgagguggaguacggcaacugcaacaccaagugccagaccccgaucggggccaucaacucgagcaugcccuuccacaacauccacccccugacgaucggcgagugccccaaguacgucaaguccaacaagcucgugcuggccaccgggcugcggaacagcccgcuccgcgagcggcgccggaagcgcggccuguucggcgcgaucgccggguucaucgagggcggguggcagggcaugguggacgggugguacggcuaccaccacuccaacgagcagggcucgggguacgccgccgacaaggaguccacccagaaggccaucgacggcgucaccaacaaggugaacagcaucaucgacaagaugaacacgcaguucgaggcgguggggcgggaguucaacaaccuggagcgccggaucgagaaccucaacaagaagauggaggacggcuuccuggacgucuggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagucggugcggaacggcaccuacgacuacccccaguacuccgaggaggcccgccugaagcgggaggagaucagcggggucaagcuggaguccaucggcacguaccagauccucagcaucuacuccaccguggccucgucccuggcgcuggccaucaugguggccgggcucagccuguggaugugcagcaacggcucccugcagugccgcaucugcaucuga

SEQ ID NO: 7954 - RNA, 1704 nt, Artificial Sequence
  derived and/or modified CDS sequence (AUadapt) from InfluenzaA__AEO89082__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagucguccuggagcgaccacgacaccuccucgggcgucuccagcgccugcccguaccagggcacgcccuccuucuuccgcaacgugguguggcugaucaagaagaacaacaccuaccccaccaucaagcggucguacaacaacaccaacaaggaggaccuccugauccugugggggauccaccacuccaacgacgcggccgagcagacgaagcucuaccagaacccgaccaccuacaucagcgucggcaccuccacgcugaaccagcgccuggugcccaagaucgccacccggucgaaggugaacgggcaguccggccgcauggacuucuucuggaccauccucaagcccaacgacgccaucaacuucgagagcaacgggaacuucaucgcgcccgaguacgccuacaagaucgucaagaagggcgacucggccaucaugaaguccgagguggaguacggcaacugcaacaccaagugccagacgccgaucggggccaucaacagcuccaugcccuuccacaacauccacccccugaccaucggcgagugccccaaguacgucaagucgaacaagcuggugcucgccaccgggcugcggaacuccccgcugcgcgagcggcgccggaagcgcggccucuucggcgcgaucgccggguucaucgagggcggguggcagggcaugguggacgggugguacggcuaccaccacagcaacgagcagggcuccggguacgccgccgacaaggagucgacccagaaggccaucgacggcgugacgaacaaggucaacuccaucaucgacaagaugaacacccaguucgaggcgguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcacguacgacuacccccaguacucggaggaggcccgccucaagcgggaggagaucuccggggugaagcuggagagcaucggcaccuaccagauccuguccaucuacucgaccgucgccuccagccucgcgcuggccaucaugguggccgggcugucccucuggaugugcucgaacggcagccugcagugccgcaucugcaucuga

SEQ ID NO: 7955 - RNA, 1704 nt, Artificial Sequence
  derived and/or modified CDS sequence (AUadapt) from InfluenzaA__AEO89091__HA
auggagaagaccguguuccugcucgccaucgucucgcuggugaaguccgaccagaucugcaucggcuaccacgccaacaacucgaccgagcaggucgacacgaucauggagaagaacgugaccgugacccacgcgcagaacauccuggagaagacccacaacgggaagcucugcgacaucgacggcgugaagccccugauccugaaggacugcuccgucgccggguggcuccugggcaacccgaugugcgacgaguucaucaacgugcccgaguggagcuacaucguggagaaggccaaccccgccaacgaccugugcuaccccgggaacuucaacgacuacgaggagcucaagcaccuccugucccgcaucaaccacuucgagaagauccagaucauccccaagucguccuggagcgaccacgaggccuccucgggcgucuccagcacgugcccguaccagggcacccccuccuucuuccggaacgugguguggcugaucaagaagaacaacaccuaccccaccaucaagcgcucguacaacaacacgaaccaggaggaccugcugauccucugggggauccaccacuccaacgacgaggcggagcaggccaagcuguaccagaacccgaccaccuacaucagcgucggcaccuccacgcugaaccagcggcucgugcccaagaucgccacccgcucgaaggugaacgggcaguccggccggauggacuucuucuggaccauccugaagcccaacgacgccaucaacuucgagagcaacgggaacuucaucgcgcccgaguacgccuacaagaucgucaagaagggcgacucggccaucaugaaguccgagguggaguacggcaacugcaacaccaagugccagacgccgaucggggccaucaacagcuccaugcccuuccacaacauccacccccugaccaucggcgagugccccaaguacgucaagucgaacaagcucgugcuggccaccgggcugcgcaacuccccgcuccgggagcgccggcgcaagcggggccuguucggcgcgaucgccggguucaucgagggcggguggcagggcaugguggacgggugguacggcuaccaccacagcaacgagcagggcuccggguacgccgccgacaaggagucgacccagaaggccaucgacggcgugacgaacaaggucaacuccaucaucgacaagaugaacacccaguucgaggcgguggggcgcgaguucaacaaccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccacaagugcgacgacgagugcauggaguccgugcgcaacggcacguacgacuacccccaguacucggaggaggcccggcugaagcgcgaggagaucuccggggugaagcuggagagcaucggcaccuaccagauccucuccaucuacucgaccgucgccuccagccuggcgcuggccaucaugauggccgggcucucccuguggaugugcucgaacggcagccugcagugccggaucugcaucuga

SEQ ID NO: 7956 - RNA, 1704 nt, Artificial Sequence
  derived and/or modified CDS sequence (AUadapt) from InfluenzaA__AEO89100__HA
auggagaagaucgugcccuuccuggccaucaucucgcucgucaaguccgaccagaucugcaucggcuaccacgccaacaacagcaccgagcaggucgacaccaucauggagaagaacgugacggugacccacgcgcaggacauccuggagaagacccacaacgggaagcugugcgaccucgacggcgugaagccgcugauccugcgcgacugcuccguggccggguggcuccugggcaaccccaugugcgacgaguucaucaacguccccgaguggucguacaucguggagaaggccaaccccgccaacgaccugugcuacccggggaacuucaacgacuacgaggagcucaagcaccuccugucccggaucaaccacuucgagaagauccagaucauccccaagaacagcugguccgaccacgaggccucguccggcgugagcuccgcgugccccuaccagggcacccccucguucuuccgcaacgucguguggcugaucaagaagaacaacacguacccgaccaucaagcgguccuacaacaacaccaaccaggaggaccugcugauccucugggggauccaccacagcaacgacgccgccgagcagaccaagcuguaccagaaccccacgaccuacaucuccgugggcaccucgacccugaaccagcgccucguccccaagaucgccacgcgguccaaggugaacgggcagagcggccgcauggacuucuucuggaccauccugaagcccaacgacgcgaucaacuucgaguccaacgggaacuucaucgccccggaguacgccuacaagaucgugaagaagggcgacucggccaucaugaaguccgaggucgaguacggcaacugcaacaccaagugccagacccccaucggggccaucaacagcucgaugcccuuccacaacauccacccccugacgaucggcgagugcccgaaguacgugaaguccaacaagcucgugcuggcgaccgggcugcggaacagcccccuccgcgagcggcgccggaagcgcggccuguucggcgccaucgccggguucaucgagggcggguggcagggcauggucgacgggugguacggcuuccaccacuccaacgagcagggcucgggguacgccgccgacaaggaguccacccagaaggcgaucgacggcgugaccaacaaggugaacagcaucaucgacaagaugaacacgcaguucgaggccgucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacgacgagugcauggagucggucaagaacggcaccuacgacuacccccaguacuccgaggaggcccggcugaagcgcgaggagaucagcggggugaagcuggaguccaucggcacguaccagauccucucgaucuacuccaccguggcgagcucccuggcccuggccaucauggucgccgggcucucgcuguggaugugcuccaacggcagccugcagugccggaucugcaucuga

SEQ ID NO: 7957 - RNA, 1704 nt, Artificial Sequence
  derived and/or modified CDS sequence (AUadapt) from InfluenzaA__AEO89109__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcgucuccucggcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacaucucggucggcaccuccacccugaaccagcgccuggugaccaagaucgccacgcggcccaaggugaacgggcagagcggccgcauggacuucuucuggaccauccucaagcccaacgacgcgaucaacuucgaguccaacgggaacuucaucgcccccgaguacgccuacaagaucgucaaggagggcgacucggccaucaugaaguccgagguggaguacggcaacugcaacaccaagugccagaccccgaucggggccaucaacagcucgaugcccuuccacaacauccacccccugacgaucggcgagugccccaaguacgugaaguccaacaagcugguccucgcgaccgggcugcggaacagcccgcugcgcgagcggcgccggaagcgcggccucuucggcgccaucgccggguucaucgagggcggguggcagggcaugguggacgggugguacggcuaccaccacuccaacgagcagggcucgggguacgccgccgacaaggaguccacccagaaggcgaucgacggcgugaccaacaaggucaacagcaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacuccaacgugaagaaccuguacgacaagguccggcuccagcugcgcgacaacgccaaggagcuggggaacggcugcuucgaguucuaccacaagugcgacaacgagugcauggagucggugcggaacggcaccuacgacuacccccaguacuccgaggaggcccgccucaagcgggaggagaucagcggggugaagcuggaguccaucggcacguaccagauccugucgaucuacuccaccgucgcgagcucccucgcccuggccaucaugguggccgggcugucgcucuggaugugcuccaacggcagccugcagugccgcaucugcaucuga

SEQ ID NO: 7958 - RNA, 1704 nt, Artificial Sequence
  derived and/or modified CDS sequence (AUadapt) from InfluenzaA__AEO89127__HA
auggagaagaucgugcugcuccuggccaucaucucgcuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguucaucaacguccccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcguguccucggcgugcccguaccagggcacccccuccuucuuccgcaacgucguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacaucucggugggcaccuccacccugaaccagcgccugguccccaagaucgccacccggagcaaggugaacgggcaguccggccgcauggacuucuucuggacgauccucaagcccaacgacgcgaucaacuucgagucgaacgggaacuucaucgcccccgaguacgccuacaagaucgugaaggagggcgacagcgccaucaugaaguccgaggucgaguacggcaacugcaacaccaagugccagaccccgaucggggccaucaacucguccaugcccuuccacaacauccacccccugaccaucggcgagugccccaaguacgucaagagcaacaagcuggugcucgcgacggggcugcggaacuccccgcugcgcgagcggcgccggcgccggggccucuucggcgccaucgccggguucaucgagggcggguggcagggcaugguggacgggugguacggcuaccaccacucgaacgagcagggcuccggguacgccgccgacaaggagagcacccagaaggcgaucgacggcgugaccaacaaggugaacuccaucaucgacaagaugaacacccaguucgaggccgucgggcgcgaguucaacaaccuggagcggcgcaucgagaaccugaacaagaagauggaggacggcuuccucgacguguggacguacaacgccgagcugcuggugcucauggagaacgagcggacccuggacuuccacgacucgaacgucaagaaccuguacgacaaggugcgccuccagcugcgggacaacgccaaggagcuggggaacggcugcuucgaguucuaccacaagugcgacaacgagugcauggaguccguccgcaacggcaccuacgacuacccccaguacagcgaggaggcccggcucaagcgcgaggagaucuccgggaucaagcuggagucgaugggcaccuaccagauccuguccaucuacagcacgguggcguccucgcucgcccuggccaucaugguggccgggcugucccucuggaugugcagcaacggcagccugcagugccgcaucugcaucuga

SEQ ID NO: 7959 - RNA, 1704 nt, Artificial Sequence
  derived and/or modified CDS sequence (AUadapt) from InfluenzaA__AEO89145__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugggggacugcuccgucgccggcuggcugcucgggaacccgaugugcgacaaguucaucaacgugcccgaguggagcuacaucguggagaaggccaaccccgccaacgaccugugcuaccccggcaacuucaacgacuacgaggagcugaagcaccuccugucccgcaucaaccacuucgagaagauccagaucauccccaagucguccuggucggaccacgaggccuccagcggcgucuccucggcgugcccguaccaggggacccccuccuucuuccggaacgugguguggcugacgaagaagaacaacaccuaccccaccaucaagcgcagcuacaacaacaccaaccaggaggaccuccugauccuguggggcauccaccacuccaacaacgccgccgagcaggagaagcucuaccagaacccgacgaccuacaucucggucgggaccuccacccugaaccagcggcuggugcccaagaucgccacgcgcucgaaggugaacggccaguccgggcggauggacuucuucuggaccauccucaagcccaacgacgcgaucaacuucgagagcaacggcaacuucaucgcccccgaguacgccuacaagaucgucaagaagggcgacucggccaucaugaaguccgggguggaguacggcaacugcaacaccaagugccagaccccgaucggggccaucaacagcuccaugcccuuccacaacauccacccccugacgaucggcgagugccccaaguacgucaagucgaacaagcuggugcucgcgaccggccugcgcaacuccccgcugcgggagcgccggcgcaagcggggccucuucggggccaucgccggguucaucgagggcggguggcagggcaugguggacggcugguacggguaccaccacucgaacgagcagggcuccggguacgccgccgacaaggagagcacccagaaggcgaucgacggcgugaccaacaaggucaacuccaucaucgacaagaugaacacgcaguucgaggccguggggcgcgaguucaacaaccuggagcggcgcaucgagaaccugaacaagaagauggaggacggcuuccucgacguguggaccuacaacgccgagcugcugguccucauggagaacgagcggacccuggacuuccacgacucgaacgugaagaaccuguacgacaagguccgccuccagcugcgggacaacgccaaggagcugggcaacgggugcuucgaguucuaccacaagugcgacaacgagugcauggaguccgugcgcaacggcaccuacgacuacccccaguacagcgaggaggcccggcucaagcgcgaggagaucuccggggugaagcuggagucgaucggcacguaccagauccuguccaucuacucgaccgcggccuccagccucgcccuggccaucauggucgccgggcugucccucuggaugugcucgaacggcagccugcagugccggaucugcaucuga

SEQ ID NO: 7960 - RNA, 1707 nt, Artificial Sequence
  derived and/or modified CDS sequence (AUadapt) from InfluenzaA__AEO89163__HA
auggagaagaucgugcugcuguucgccaucgucucgcuggugaaguccgaccacaucugcaucggcuaccacgccaacaacucgaccgagcaggucgacaccaucauggagaagaacgugacggugacccacgcgcaggacauccuggagaagacccacaacgggaagcucugcgaccugaacggcgugaagccccugauccucaaggacugcuccgucgccggguggcugcugggcaacccgaugugcgacgaguucaucgacgugcccgaguggagcuacaucguggagaaggccaaccccgccaacgaccucugcuaccccgggaacuucaacgacuacgaggagcugaagcaccuccucucccgcaucaaccacuucgagaagauccagaucaucccgaaggacucguggcccgaccacgaggccucccugggcgucagcuccgcgugccccuaccagggcaacucguccuucuuccggaacgugguguggcugaucaagaaggggaacgccuaccccaccaucaagaaguccuacaacaacacgaacaaggaggaccuccugauccuguggggcauccaccacccgaacgacgaggccgagcagacccgccucuaccagaaccccaccaccuacaucagcaucgggacgucgacccugaaccagcggcuggucccccgcaucgccacccgguccaaggugaacggccagagcgggcgcaucgacuucuucuggaccauccucaagcccaacgacgcgaucaacuucgaguccaacggcaacuucaucgccccggaguacgccuacaagaucgugaagaagggcgacucgacgaucaugaaguccgaggucgaguacgggaacugcaacacccggugccagacccccaugggcgccaucaacagcucgaugcccuuccacaacauccacccccugaccaucggggagugcccgaaguacgugaaguccaacaagcuggugcucgccacgggccugcgcaacagcccccagcgggagcgccggcgccggaagcgcggccuguucggggcgaucgccggcuucaucgagggcggguggcaggggauggucgacggcugguacggcuaccaccacuccaacgagcaggggucgggcuacgccgccgacaaggaguccacccagaaggccaucgacggggugaccaacaaggugaacagcaucaucgacaagaugaacacccaguucgaggcggucggccgggaguucaacaaccucgagcgccggaucgagaaccugaacaagaagauggaggacggguuccuggacguguggacguacaacgccgagcuccuggugcugauggagaacgagcgcacccucgacuuccacgacuccaacgucaagaaccuguacgacaaggugcggcugcagcuccgcgacaacgccaaggagcugggcaacggcugcuucgaguucuaccacaagugcgacaacgagugcauggagucgguccggaacgggaccuacgacuacccccaguacuccgaggaggcccgccugaagcgcgaggagaucagcggcgugaagcucgaguccaucgggaccuaccagauccugucgaucuacuccacgguggccagcucccugguccucgcgaucaugguggccggccugucgcuguggaugugcuccaacgggagccuccagugccggaucugcaucuga

SEQ ID NO: 7961 - RNA, 1704 nt, Artificial Sequence
  derived and/or modified CDS sequence (AUadapt) from InfluenzaA__AEO89172__HA
auggagaagaucgugcugcuccuggccaucgucucgcuggugcgcuccgaccagaucugcaucggcuaccacgccaacaacagcaccgagcaggucgacaccaucauggagaagaacgugacggugacccacgcgcagaacauccucgagaagacccacaacgggaagcugugcgaccuggacggcgugaagccccucauccugcgggacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccgcaucaaccacuucgagaagauccagaucauccccaagagcuccuggucggaccacgaggccuccagcggcgucuccagcgcgugcccguaccagggcacccccuccuucuuccggaacgugguguggcugaucaagaagaacaacacguaccccaccaucaagcgcucguacaacaacaccaaccaggaggaccuccugguccugugggggauccaccacuccaacgacgccaccgagcagaucaagcucuaccagaacccgacgaccuacgugagcgugggcaccuccacccugaaccagcggcugguccccaagaucgccacgcgcucgaaggugaacgggcaguccggccggauggacuucuucuggaccauccucaagagcaacgacgccaucaacuucgagagcaacgggaacuucaucgcgcccgaguacgccuacaagaucgugaagaagggcgacuccgccaucaugaaguccgaggucgaguacggcaacugcuccaccaagugccagacccccaucggggccaucaacucguccaugccguuccacaacauccacccccugacgaucggcgagugccccaaguacgucaagagcaacaagcuggugcucgccaccgggcugcgcaacucgccccugcgggagcgccggcgcaagcggggccucuucggcgcgaucgccggguucaucgagggcggguggcagggcaugguggacgggugguacggcuaccaccacagcaacgagcagggcuccggguacgccgccgacaaggagucgacccagaaggccaucgacggcgugaccaacaaggugaacuccaucaucgacaagaugaacacgcaguucgaggcggucgggcgcgaguucaacaaccuggagcggcgcaucgagaaccugaacaagaagauggaggacggcuuccucgacguguggaccuacaacgccgagcugcugguccucauggagaacgagcggacccuggacuuccacgacagcaacgugaagaaccuguacgacaaggugcgccuccagcugcgggacaacgccaaggagcuggggaacggcugcuucgaguucuaccacaagugcgacaacgagugcauggaguccguccgcaacggcaccuacgacuacccgcaguacagcgaggaggcccggcucaagcgcgaggagaucuccggggugaagcuggagucgaucggcacguaccagauccuguccaucuacagcaccguggccuccucgcucgcgcuggccaucauggucgccgggcugagccucuggaugugcuccaacggcagccugcagugccgcaucugcaucuga

SEQ ID NO: 7962 - RNA, 1704 nt, Artificial Sequence; identical to SEQ ID NO: 210
  derived and/or modified CDS sequence (AUadapt) from InfluenzaA__AEO89181__HA

SEQ ID NO: 7963 - RNA, 1704 nt, Artificial Sequence
  derived and/or modified CDS sequence (AUadapt) from InfluenzaA__AEO89192__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcgucuccucggcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacgucucgaucggcaccuccacccugaaccagcgccuggugcccaagaucgccacccggagcaaggugaacgggcaguccggccgcauggacuucuucuggacgauccucaagcccaacgacgcgaucaacuucgagucgaacgggaacuucaucgcccccgaguacgccuacaagaucgucaaggagggcgacagcgccaucaugaaguccgagguggaguacggcaacugcaacaccaagugccagaccccgaucggggccaucaacucguccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuacccccacucgaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacucgaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucaacggggugaagcuggaguccaucggcaccuaccagauccugucgaucuacuccacggucgcgagcucccucgcccuggccaucaugguggccgggcugucgcucuggaugugcuccaacggcagccugcagugccgcaucugcaucuga

SEQ ID NO: 7964 - RNA, 1704 nt, Artificial Sequence
  derived and/or modified CDS sequence (AUadapt) from InfluenzaA__AEO89203__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcgucuccucggcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacgucucgaucggcaccuccacccugaaccagcgccuggugcccaagaucgccacccggagcaaggugaacgggcaguccggccgcauggacuucuucuggacgauccucaagcccaacgacgcgaucaacuucgagucgaacgggaacuucaucgcccccgaguacgccuacaagaucgucaaggagggcgacagcgccaucaugaaguccgagguggaguacggcaacugcaacaccaagugccagaccccgaucggggccaucaacucguccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacucgaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacucgaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucaacggggugaagcuggaguccaucggcaccuaccagauccugucgaucuacuccacggucgcgagcucccucgcccuggccaucaugguggccgggcugucgcucuggaugugcuccaacggcagccugcagugccgcaucugcaucuga

SEQ ID NO: 7965 - RNA, 1704 nt, Artificial Sequence; identical to SEQ ID NO: 7964
  derived and/or modified CDS sequence (AUadapt) from InfluenzaA__AEO89213__HA

SEQ ID NO: 7966 - RNA, 1704 nt, Artificial Sequence; identical to SEQ ID NO: 7964
  derived and/or modified CDS sequence (AUadapt) from InfluenzaA__AEO89224__HA

SEQ ID NO: 7967 - RNA, 1704 nt, Artificial Sequence
  derived and/or modified CDS sequence (AUadapt) from InfluenzaA__AEO89235__HA
auggagaagaucgugcugcuccuggccauggucucgcuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguucaucaacgugcccgaguggucguacaucguggagaaggccaaccccgccaacgaccugugcuaccccgggaaccugaacgacuacgaggagcucaagcaccuccugucccgcaucaaccacuucgagaagauccagaucauccccaagagcuccuggucggaccacgaggccucccugggcgucagcuccgcgugcccguaccagggcacccccucguucuuccggaacgugaucuggcugaucaagaagaacaacacguaccccaccaucaagcgcuccuacaacaacaccaaccaggaggaccugcucauccugugggggauccaccacagcaacgacgaggccgagcagaucaagcuguaccagaacccgaccacguacaucuccgugggcaccucgacccucaaccagcggcugguccccaagaucgccacccgcuccaaggugaacgggcagagcggccggauggacuucuucuggacgauccugaagcccgacgacgccaucaacuucgaguccaacgggaacuucaucgcgcccgaguacgccuacaagaucgugaagaagggcgacucggccaucaugaaguccgaggucgaguacggcaacugcaacaccaagugccagaccccgaucggggccaucaacagcucgaugcccuuccacaacauccacccccucaccaucggcgagugccccaaguacgugaaguccaacaagcuggugcuggccacggggcuccgcaacagcccgcugcgggagaagcgccggaagcgcggccuguucggcgcgaucgccggguucaucgagggcggguggcagggcauggucgacgggugguacggcuaccaccacuccaacgagcagggcucgggguacgccgccgacaaggaguccacccagaaggccaucgacggcgugaccaacaaggugaacagcaucaucgacaagaugaacacccaguucgaggcggucgggcgggaguucaacaaccucgagcgccggaucgagaaccugaacaagaagauggaggacggcuuccuggacguguggacguacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcgacaacgagugcauggagucgguccggaacggcaccuacgacuacccccaguacuccgaggaggcccgccugaagcgggaggagaucagcggggugaagcucgaguccaucggcaccuaccagauccugucgaucuacuccacgguggccagcucccuggcgcucgccaucauggucgccgggcugucgcuguggaugugcuccaacggcagccuccagugccgcaucugcaucuga

SEQ ID NO: 7968 - RNA, 1704 nt, Artificial Sequence
  derived and/or modified CDS sequence (AUadapt) from InfluenzaA__AEO89246__HA
auggagaagaucgugccccugcucgccauggucucgcuggugaaguccgaccagaucugcaucggcuaccacgccaacaacucgaccgagcaggucgacaccaucauggagaagaacgugacggugacccacgcgcaggacauccuggagaagacccacaacgggaagcucugcgaccuggacggcgugaagccgcugauccuccgcgacugcuccgucgccggguggcugcugggcaaccccaugugcgacgaguucaucaacgugcccgaguggagcuacaucguggagaaggccaaccccgccaacgaccucugcuacccggggaaccugaacgacuacgaggagcugaagcaccuccugucccggaucaaccacuucgagaagauccagaucauccccaagucguccuggagcgaccacgaggccucccugggcgucucguccgcgugccccuaccagggcacccccagcuucuuccgcaacgugguguggcucaucaagaagaacaacacguacccgaccaucaagcgguccuacaacaacaccaaccaggaggaccugcugauccucugggggauccaccacucgaacgacgaggccgagcagaucaagcuguaccagaaccccaccacguacaucuccgucggcaccagcacccugaaccagcgccucgugcccaagaucgccacccgguccaaggugaacgggcagucgggccgcauggacuucuucuggacgauccugaagcccgacgacgccaucaacuucgaguccaacgggaacuucaucgcgccggaguacgccuacaagaucgucaagaagggcgacagcgccaucaugaaguccgagguggaguacggcaacugcaacaccaagugccagacccccaucggggccaucaacucgagcaugcccuuccacaacauccacccccugaccaucggcgagugcccgaaguacgugaaguccaacaagcucguccuggccacggggcugcggaacucgccccuccgcgagcggcgccggaagcgcggccuguucggcgcgaucgccggguucaucgagggcggguggcagggcaugguggacgggugguacggcuaccaccacuccaacgagcagggcagcggguacgccgccgacaaggaguccacccagaaggccaucgacggcgugaccaacaaggucaacucgaucaucgacaagaugaacacccaguucgaggcgguggggcgggaguucuccaaccuggagcgccggaucgagaaccucaacaagaagauggaggacggcuuccuggacguguggacguacaacgccgagcugcucguccugauggagaacgagcgcacccuggacuuccacgacagcaacgugaagaaccucuacgacaagguccggcugcagcugcgcgacaacgccaaggagcucgggaacggcugcuucgaguucuaccacaagugcgacaacgagugcauggaguccgugcggaacggcaccuacgacuacccccaguacucggaggaggcccgccugaagcgggaggagaucuccggggugaagcuggagagcaucggcaccuaccagauccucuccaucuacucgacggucgccuccagccuggcgcuggccaucaugguggccgggcucucccuguggaugugcucgaacggcagccugcagugccgcaucugcaucuga

SEQ ID NO: 7969 - RNA, 1704 nt, Artificial Sequence
  derived and/or modified CDS sequence (AUadapt) from InfluenzaA__AEO89257__HA
auggagaagaucgugcugcuccuggccaucgucucgcuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccgcaucaaccacuucgagaagauccagaucauccccaagagcuccuggagcgaccacgaggccuccucgggcgucuccagcgcgugcccguaccagggcacccccuccuucuuccggaacgugguguggcugaucaagaagaacaacacguaccccaccaucaagcgcagcuacaacaacaccaaccaggaggaccuccugguccugugggggauccaccacuccaacgacgccgccgagcagaucaagcucuaccagaacccgaccacguacgugucggugggcaccuccacccugaaccagcggcugguccccaagaucgccacccgcagcaaggugaacgggcaguccggccggauggacuucuucuggacgauccucaagucgaacgacgcgaucaacuucgagagcaacgggaacuucaucgcccccgaguacgccuacaagaucgugaagaagggcgacuccgccaucaugaaguccgaggucgaguacggcaacugcuccaccaagugccagacccccaucggggccaucaacagcuccaugccguuccacaacauccacccccugaccaucggcgagugccccaaguacgucaagucgaacaagcuggugcucgcgacggggcugcgcaacagcccccugcgggagcgccggcgcaagcggggccucuucggcgccaucgccggguucaucgagggcggguggcagggcaugguggacgggugguacggcuaccaccacagcaacgagcagggcuccggguacgccgccgacaaggagucgacccagaaggcgaucgacggcgugaccaacaaggugaacuccaucaucgacaagaugaacacccaguucgaggccgucgggcgcgaguucaacaaccuggagcggcgcaucgagaaccugaacaagaagauggaggacggcuuccucgacguguggacguacaacgccgagcugcugguccucauggagaacgagcggacccuggacuuccacgacagcaacgugaagaaccuguacgacaaggugcgccuccagcugcgggacaacgccaaggagcuggggaacggcugcuucgaguucuaccacaagugcgacaacgagugcauggaguccguccgcaacggcaccuacgacuacccgcaguacucggaggaggcccggcucaagcgcgaggagaucuccggggugaagcuggagagcaucggcaccuaccagauccuguccaucuacagcacgguggcguccucgcucguccuggccaucaugguggccgggcugagccucuggaugugcuccaacggcagccugcagugccgcaucugcaucuga

SEQ ID NO: 7970 - RNA, 1704 nt, Artificial Sequence; identical to SEQ ID NO: 7969
  derived and/or modified CDS sequence (AUadapt) from InfluenzaA__AEO89268__HA

SEQ ID NO: 7971 - RNA, 1704 nt, Artificial Sequence
  derived and/or modified CDS sequence (AUadapt) from InfluenzaA__AEO89279__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugggggacugcuccgucgccggcuggcugcucgggaacccgaugugcgacaaguucaucaacgugcccgaguggagcuacaucguggagaaggccaaccccgccaacgaccugugcuaccccggcaacuucaacgacuacgaggagcugaagcaccuccugucccgcaucaaccacuucgagaagauccagaucauccccaagucguccuggagcgaccacgaggccuccucgggcgucuccagcgcgugcccguaccaggggacccccuccuucuuccggaacgugguguggcugaucaagaagaacaacacguaccccaccaucaagcgcucguacaacaacaccaaccaggaggaccuccugauccuguggggcauccaccacuccaacaacgccgccgagcaggagaagcucuaccagaacccgaccacguacaucucggucgggaccuccacccugaaccagcggcuggugcccaagaucgccacccgcagcaaggugaacggccaguccgggcggauggacuucuucuggacgauccucaagcccaacgacgcgaucaacuucgagucgaacggcaacuucaucgcccccgaguacgccuacaagaucgucaagaagggcgacagcgccaucaugaaguccggggugaaguacggcaacugcaacaccaagugccagaccccgaucggggccaucaacucguccaugcccuuccacaacauccacccccugaccaucggcgagugccccaaguacgucaagagcaacaagcuggugcucgcgacgggccugcgcaacuccccgcugcgggagcgccggcgcaagcggggccucuucggggccaucgccggguucaucgagggcggguggcagggcaugguggacggcugguacggguaccaccacucgaacgagcagggcuccggguacgccgccgacaaggagucgacccagaaggcgaucgacggcgugaccaacaaggucaacuccaucaucgacaagaugaacacccaguucgaggccguggggcgcgaguucaacaaccuggagcggcgcaucgagaaccugaacaagaagauggaggacggcuuccucgacguguggacguacaacgccgagcugcugguccucauggagaacgagcggacccuggacuuccacgacagcaacgugaagaaccuguacgacaagguccgccuccagcugcgggacaacgccaaggagcugggcaacgggugcuucgaguucuaccacaagugcgacaacgagugcauggaguccgugcgcaacggcaccuacgacuacccccaguacucggaggaggcccggcucaagcgcgaggagaucuccggggugaagcuggagagcaucggcaccuaccagauccuguccaucuacucgacggcggccuccagccucgcccuggccaucauggucgccgggcugucccucuggaugugcucgaacggcagccugcagugccggaucugcaucuga

SEQ ID NO: 7972 - RNA, 1704 nt, Artificial Sequence
  derived and/or modified CDS sequence (AUadapt) from InfluenzaA__AEO89289__HA
auggagaagaucgugcugcuccuggccaucgucucgcuggccaaguccgaccagaucugcaucggcuaccacgcgaacaacucgaccgagcaggucgacaccaucauggagaagaacgugacggugacccacgcccaggacauccucgagaagacccacaacgggaagcugugcgaccuggacggcgugaagccccucauccugggggacugcuccguggccggcuggcugcucgggaacccgaugugcgacaaguucaucaacguccccgaguggagcuacaucguggagaaggugaaccccgccaacgaccugugcuaccccggcaacuucaacgacuacgaggagcugaagcaccuccugucccgcaucaaccacuucgagaagaucaagaucauccccaagucguccuggagcgaccacgaggccuccucgggcgucuccagcgcgugcccguaccaggggacccccuccuucuuccggaacgugguguggcugaucaagaagaacaacacguaccccaccaucaagcgcucguacaacaacaccaaccaggaggaccuccugauccuguggggcauccaccacuccaacaacgucgccgagcaggagaagcucuaccagaacccgaccacguacaucagcguggggaccuccacccugaaccagcggcuggugcccaagaucgccacccgcucgaaggucaacggccaguccgggcggauggacuucuucuggacgauccucaagcccaacgacaccaucaacuucgagagcaacggcaacuucaucgcccccgaguacgcguacaagaucgugaagaagggcgacucggccaucaugaaguccgggguggaguacggcaacugcaacaccaagugccagaccccgaucggggccaucaacagcuccaugcccuuccacaacauccacccccugacgaucggcgagugccccaaguacgucaagucgaacaagcuggugcucgccaccggccugcgcaacuccccgcugcgggagcgccggcgcaagcggggccucuucggggccaucgcgggguucaucgagggcggguggcagggcaugguggacggcugguacggguaccaccacagcaacgagcagggcuccggguacgccgccgacaaggagucgacccagaaggccaucgacggcgucaccaacaaggugaacuccaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacagcaacgucaagaaccuguacgacaaggugcgccuccagcugcgggacaacgccaaggagcugggcaacgggugcuucgaguucuaccacaagugcgacaacgagugcauggaguccgugcgcaacggcaccuacgacuacccccgguacucggaggaggcccgccucaagcgggaggagaucuccggggucaagcuggagagcaucggcacguaccagauccuguccaucuacucgaccgccgccuccagccucgcgcuggccaucaugguggccgggcugucccucuggaugugcucgaacggcagccugcagugccgcaucugcaucuga

SEQ ID NO: 7973 - RNA, 1704 nt, Artificial Sequence
  derived and/or modified CDS sequence (AUadapt) from InfluenzaA__AEO89300__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcgucuccucggcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagcacccgaccacguacaucucggucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaaggagggcgacucggccaucaugaaguccgagguggaguacggcaacugcaacaccaagugccagaccccgaucggggccaucaacagcuccaugcccuuccacaacauccacccccugaccaucggcgagugccccaaguacgucaagucgaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagucgacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacucggaggaggcccgccucaagcgggaggagaucaacggggugaagcuggaguccaugggcaccuaccagauccugagcaucuacuccacggucgcgucgucccucgcccuggccaucaugguggccgggcugagcuucuggaugugcuccaacggcagccuccagugccgcaucugcaucuga

SEQ ID NO: 7974 - RNA, 1704 nt, Artificial Sequence
  derived and/or modified CDS sequence (AUadapt) from InfluenzaA__AEO89311__HA
auggagaagaucgugcugcuguucgccaucgucucgcuggugaaguccgaccacaucugcaucggcuaccacgccaacaacagcaccgagcaggucgacaccaucauggagaagaacgugacggugacccacgcgcaggacauccuggagaagacccacaacgggaagcucugcgaccugaacggcgugaagccccugauccucaaggacugcuccgucgccggguggcugcugggcaacccgaugugcgacgaguucaucaacgugcccgaguggucguacaucguggagaaggccaaccccgccaacgaccucugcuaccccgggaacuucaacgacuacgaggagcugaagcaccuccucucccgcaucaaccacuucgagaagauccagaucaucccgaaggacagcugguccgaccacgaggccucgcugggcgucuccgcggccugccccuaccagggcaacagcuccuucuuccggaacgugguguggcugaucaagaaggacaacgccuaccccaccaucaagaaguccuacaacaacacgaaccaggaggaccuccugauccugugggggauccaccaccccaacgacgaggccgagcagacccgccucuaccagaacccgaccaccuacaucucgaucggcacgagcacccugaaccagcggcugguccccaagaucgcgacccgcuccaaggugaacgggcagucgggccggaucgacuucuucuggaccauccucaagcccaacgacgccauccacuucgaguccaacgggaacuucaucgcccccgaguacgccuacaagaucgugaagaagggcgacagcacgaucaugaaguccgaggucgaguacggcaacugcaacacccgcugccagaccccgaugggggccaucaacucgagcaugcccuuccacaacauccacccccugaccaucggcgagugccccaaguacgugaaguccacgaagcuggugcucgcgaccgggcugcggaacucgccgcagcgcgagcggcgccggaagcgcggccuguucggcgccaucgccggguucaucgagggcggguggcagggcauggucgacgggugguacggcuaccaccacuccaacgagcagggcagcggguacgccgccgacaaggaguccacccagaaggcgaucgacggcgugaccaacaaggugaacucgaucaucgacaagaugaacacgcaguucgaggccgucgggcgggaguucaacaagcucgagcgccggaucgagaaccugaacaagaagauggaggacggcuuccuggacguguggaccuacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcaacaacgagugcauggagagcguccggaacggcaccuacgacuacccccaguacuccgaggaggcccgccugaagcgggaggagaucucgggggugaagcucgaguccaucggcaucuaccagauccugagcaucuacuccacgguggcgucgucccugguccucgccaucaugauggccgggcugagccuguggaugugcuccaacggcagccuccagugccgcaucugcaucuga

SEQ ID NO: 7975 - RNA, 1701 nt, Artificial Sequence; identical to SEQ ID NO: 2173
  derived and/or modified CDS sequence (AUadapt) from InfluenzaA__AEO99215__HA

SEQ ID NO: 7976 - RNA, 1698 nt, Artificial Sequence
  derived and/or modified CDS sequence (AUadapt) from InfluenzaA__AEQ38187__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccggggccuccgccagcugcucccacaacggcgagaacucguucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcucgcacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacucgaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcucgggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacucggaggaguccaagcugaaccgcgagaagaucgacggggugaagcucgagagcaugggcguguaccagauccuggccaucuacuccaccgucgccagcucgcuggugcuccuggugucccugggcgccaucagcuucuggaugugcuccaacgggagccuccagugccggaucugcaucuga

SEQ ID NO: 7977 - RNA, 1698 nt, Artificial Sequence; identical to SEQ ID NO: 7976
  derived and/or modified CDS sequence (AUadapt) from InfluenzaA__AEQ38188__HA

SEQ ID NO: 7978 - RNA, 1698 nt, Artificial Sequence
  derived and/or modified CDS sequence (AUadapt) from InfluenzaA__AEQ38189__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccaaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccucgagccuggugcuccuggucucccugggcgccaucagcuucuggaugugcuccaacgggagccuccagugccggaucugcaucuga

SEQ ID NO: 7979 - RNA, 1698 nt, Artificial Sequence
  derived and/or modified CDS sequence (AUadapt) from InfluenzaA__AEQ38190__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagcccuacgccaacaacaaggagaaggaggugcucguccuguggggcgugcaccacccgcccaacaucgccgugcagaagacccuguaccacacggagaacgccuacgucagcgugguguccucgcacuacagccggaaguucacccccgagaucgccaagcgccccaagguccgggaccaggagggccgcaucaacuacuacuggacccuccuggagccgggcgacaccaucaucuucgaggcgaacgggaaccugaucgcgccccgguacgccuucgcccucucccgcggcuucgggagcggcaucaucaacuccaacgcccccauggacaagugcgacgccaagugccagacgccccagggcgccaucaacucgucccugccguuccagaacgugcaccccgugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacucgaacgucaagaaccucuacgagaaggugaagucccagcugaagaacaacgcgaaggagaucggcaacgggugcuucgaguucuaccacaagugcaacgacgagugcauggagagcgugaagaacggcaccuacgacuacccgaaguacuccgaggagagcaagcugaaccgcgagaagaucgacggggucaagcucgaguccaugggcguguaccagauccuggccaucuacucgaccguggccuccagccugguccuccuggugagccugggcgccaucuccuucuggaugugcagcaacgggucccuccagugccggaucugcaucuga

SEQ ID NO: 7980 - RNA, 1698 nt, Artificial Sequence; identical to SEQ ID NO: 3871
  derived and/or modified CDS sequence (AUadapt) from InfluenzaA__AEQ38191__HA

SEQ ID NO: 7981 - RNA, 1698 nt, Artificial Sequence
  derived and/or modified CDS sequence (AUadapt) from InfluenzaA__AEQ38192__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacucgcggaaguucacccccgagaucaccaagcgccccaaggugcgggaccaggagggccgcaucaacuacuacuggacccuccuggagcccggcgacacgaucaucuucgaggccaacgggaaccugaucgccccgcgguacgcguucgcccucucccgcggcuucgggagcggcaucaucaacuccaacacccccauggacaagugcgacaccaagugccagacgccccagggcgccaucaacagcucccugcccuuccagaacguccacccggugaccaucggggagugccccaaguacgugcggagcgccaagcugcgcauggucaccggccuccggaacauccccuccauccagucgcgcgggcuguucggcgccaucgcgggguucaucgagggcggcuggaccgggaugguggacggcugguacggguaccaccaccagaacgagcagggcuccggguacgccgccgaccagaaguccacccagaacgccaucaacggcaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgcggagcugcuggugcuccuggagaacgagcggacgcuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggugaagcucgagagcaugggcgucuaccagauccuggccaucuacuccaccguggccagcucccuggugcuccuggucagccugggcgccaucuccuucuggaugugcagcaacgggucccuccagugccggaucugcaucuga

SEQ ID NO: 7982 - RNA, 1698 nt, Artificial Sequence
  derived and/or modified CDS sequence (AUadapt) from InfluenzaA__AEQ38193__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggugaccggggucuccgccagcugcucccacaacggcgagucguccuucuaccgcaaccugcuguggcucaccgggaagaacggccuguaccccaaccugagcaaguccuacgccaacaacaaggagaaggaggugcucgugcuguggggcguccaccacccgcccaacaucguggaccagaagacccuguaccggacggagaacgccuacgugagcgucgugagcucccacuacucgcgcaaguucacccccgagaucgccaagcggcccaaggugcgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcgcagcgccaagcugcggauggucaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacggggugaagcucgaguccaugggcgucuaccagauccuggcgaucuacagcaccguggccagcucccuggugcuccuggucagccugggcgccaucuccuucuggaugugcagcaacgggucccuccagugccgcaucugcaucuga

SEQ ID NO: 7983 - RNA, 1698 nt, Artificial Sequence
  derived and/or modified CDS sequence (AUadapt) from InfluenzaA__AEQ38194__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccagcaucagcgaccagaagacccuguaccacacggagaacgccuacguguccgucgugagcucccacuacucgcggaaguucacccccgagaucgccaagcgccccaaggugcgggaccaggagggccgcaucaacuacuacuggacccuccuggagcccggcgacaccaucaucuucgaggccuccgggaaccugaucgcgccgcgguacgccuucgcccucagccgcggcuucggguccggcaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccggaacgagcagggcucgggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccucaacaagcgcgucgacgacggguucaucgacaucuggacguacaacgccgagcugcuggugcuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggagucgaagcugaaccgcgagaagaucgacggggugaagcucgaguccaugggcgucuaccagauccuggcgaucuacagcaccguggccuccagccuggugcuccuggucucccugggcgccaucagcuucuggaugugcuccaacgggagccuccagugccggaucugcaucuga

SEQ ID NO: 7984 - RNA, 1698 nt, Artificial Sequence
  derived and/or modified CDS sequence (AUadapt) from InfluenzaA__AEQ38195__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccggggccuccgccagcugcucccacaacggcgagaacucguucuaccgcaaccugcuguggcucaccgggaagaacggccuguaccccaaccuguccaagagcuacgccaacaacaaggagaaggaggugcucgugcuguggggcguccaccacccgcccaacaucgccaaccagaagacccuguaccacacggagaacgccuacguguccguggucagcucgcacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacucgaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcucgggguacgccgccgaccagaaguccacgcagaacgccaucaacggcaucaccaacaaggugaacagcgugaucgagaagaugaacacccaguucaccgccaugggcaaggaguucaacaagcuggagcggcgcauggagaaccucaacaagaaggucgacgacggguucaucgacaucuggacguacaacgcggagcugcuggugcuccuggagaacgagcggacccuggacuuccacgacuccaacgucaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacucggaggaguccaagcugaaccgcgagaagaucgacggggugaagcucgagagcaugggcguguaccagauccuggccaucuacuccaccguggccagcucgcugguccuccuggugucccugggcgccaucagcuucuggaugugcuccaacgggagccuccagugccggaucugcaucuga

SEQ ID NO: 7985 - RNA, 1698 nt, Artificial Sequence
  derived and/or modified CDS sequence (AUadapt) from InfluenzaA__AEQ38196__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccggggccuccgccagcugcucccacaacggcgagaacucguucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcucgcacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacucgaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcucgggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgaguaccccaaguacucggaggaguccaagcugaaccgcgagaagaucgacggggugaagcucgagagcaugggcguguaccagauccuggccaucuacuccaccgucgccagcucgcuggugcuccuggugucccugggcgccaucagcuucuggaugugcuccaacgggagccuccagugccggaucugcaucuga

SEQ ID NO: 7986 - RNA, 1698 nt, Artificial Sequence; identical to SEQ ID NO: 7976
  derived and/or modified CDS sequence (AUadapt) from InfluenzaA__AEQ38197__HA

SEQ ID NO: 7987 - RNA, 1698 nt, Artificial Sequence; identical to SEQ ID NO: 7976
  derived and/or modified CDS sequence (AUadapt) from InfluenzaA__AEQ38198__HA

SEQ ID NO: 7988 - RNA, 1701 nt, Artificial Sequence; identical to SEQ ID NO: 7295
  derived and/or modified CDS sequence (AUadapt) from InfluenzaA__AEQ62909__HA

SEQ ID NO: 7989 - RNA, 1701 nt, Artificial Sequence
  derived and/or modified CDS sequence (AUadapt) from InfluenzaA__AEQ62910__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccgccucccccgacaacggcacgugcuaccccggcgacuucaucgacuacgaggagcugcgggagcagcucagcuccgugucguccuucgagcgcuucgagaucuuccccaagaccucguccuggccgaaccacgacagcaacaagggggucaccgccgccugcccccacgcgggcgccaaguccuucuacaagaaccugauguggcuggugaagaaggggaacucguaccccaagcucuccaagagcuacaucaacgacaagggcaaggaggugcugguccugugggggauccaccacccgcccaccuccgccgaccagcagucgcucuaccagaacgccgacgccuacguguucgugggcacgagccgguacuccaagaaguucaagcccgagaucgcgauccgccccaagguccggggccaggaggggcgcaugaacuacuacuggacccugguggagcccggcgacaagaucaccuucgaggccaccgggaaccugguggucccgcgguacgccuucgccauggagcgcaacgccggcucgggcaucaucaucuccgacacgcccgugcacgacugcaacacgaccugccagucgcccaagggggcgaucaacaccucccuccccuuccagaacauccacccgaucaccaucggcgagugccccaaguacgucaagagcaccaagcugcggcuggccaccgggcuccgcaacgugcccuccgugcagucgcggggccuguucggggccaucgccggcuucaucgagggcggguggaccggcaugguggacgggugguacggcuaccaccaccagaacgagcagggguccggcuacgccgcggaccucaagagcacgcagaacgccaucgacgagaucaccaacaaggucaacuccgugaucgagaagaugaacacccaguucaccgccgucggcaaggaguucaaccagcuggagaagcgcaucgagaaccugaacaagaagguggacgacggguuccuggacaucuggacguacaacgccgagcuccuggugcugcucgagaacgagcggacccuggacuaccacgacucgaacgucaagaaccuguacgagaaggugcgcucccagcucaagaacaacgccaaggagaucggcaacgggugcuucgaguucuaccacaagugcgacaacacgugcauggagucggugaagaacggcaccuacgacuaccccaaguacuccgaggaggcgaagcugaaccgggaggagaucgacggggucaagcuggagagcacccgcaucuaccagauccucgccaucuacuccaccguggccucgucccuggugcuggucgugagccucggcgccaucucguucuggaugugcuccaacggcagccugcagugccggaucugcaucuga

SEQ ID NO: 7990 - RNA, 1701 nt, Artificial Sequence; identical to SEQ ID NO: 7112
  derived and/or modified CDS sequence (AUadapt) from InfluenzaA__AEQ62911__HA

SEQ ID NO: 7991 - RNA, 1701 nt, Artificial Sequence; identical to SEQ ID NO: 7295
  derived and/or modified CDS sequence (AUadapt) from InfluenzaA__AEQ62912__HA

SEQ ID NO: 7992 - RNA, 1701 nt, Artificial Sequence
  derived and/or modified CDS sequence (AUadapt) from InfluenzaA__AEQ62915__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagacgaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 7993 - RNA, 1701 nt, Artificial Sequence; identical to SEQ ID NO: 3656
  derived and/or modified CDS sequence (AUadapt) from InfluenzaA__AER08646__HA

SEQ ID NO: 7994 - RNA, 1701 nt, Artificial Sequence; identical to SEQ ID NO: 5664
  derived and/or modified CDS sequence (AUadapt) from InfluenzaA__AER08648__HA

SEQ ID NO: 7995 - RNA, 1701 nt, Artificial Sequence
  derived and/or modified CDS sequence (AUadapt) from InfluenzaA__AER08652__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccucggacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccugaaguccacccaggccgccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 7996 - RNA, 1701 nt, Artificial Sequence; identical to SEQ ID NO: 7995
  derived and/or modified CDS sequence (AUadapt) from InfluenzaA__AER08654__HA

SEQ ID NO: 7997 - RNA, 1701 nt, Artificial Sequence
  derived and/or modified CDS sequence (AUadapt) from InfluenzaA__AER08656__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagaugcagucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 7998 - RNA, 1701 nt, Artificial Sequence
  derived and/or modified CDS sequence (AUadapt) from InfluenzaA__AER08660__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 7999 - RNA, 1701 nt, Artificial Sequence
  derived and/or modified CDS sequence (AUadapt) from InfluenzaA__AER08664__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacagcgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaggccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucacguacggggcgugcccccgguacgucaagcaguccacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcucaagucgggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 8000 - RNA, 1701 nt, Artificial Sequence; identical to SEQ ID NO: 7227
  derived and/or modified CDS sequence (AUadapt) from InfluenzaA__AER08668__HA

SEQ ID NO: 8001 - RNA, 1701 nt, Artificial Sequence
  derived and/or modified CDS sequence (AUadapt) from InfluenzaA__AER08670__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugaaguccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 8002 - RNA, 1701 nt, Artificial Sequence
  derived and/or modified CDS sequence (AUadapt) from InfluenzaA__AER08672__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacgggggcaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacgcuggaguucaacagcgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucgcagcaggccgugaucccgaacaucgggucccggccccgcguccggaacauccccagccgcaucuccaucuacuggaccaucgugaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucacguacggggcgugcccccgguacgucaagcaguccacccugaagcucgccaccggcaugcgcaacgugcccgagaagcagacccgggggaucuucggcgccaucgccggcuucaucgagaacgggugggagggcaugguggacgggugguacggcuuccgccaccagaacucggaggggcggggccaggccgcggaccugaaguccacgcaggccgccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggcgugccagaaggggaacauccggugcaacaucugcaucuga

SEQ ID NO: 8003 - RNA, 1701 nt, Artificial Sequence
  derived and/or modified CDS sequence (AUadapt) from InfluenzaA__AER08674__HA
augaagaccaucaucgcccugucguacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8004 - RNA, 1701 nt, Artificial Sequence; identical to SEQ ID NO: 7227
  derived and/or modified CDS sequence (AUadapt) from InfluenzaA__AER08676__HA

SEQ ID NO: 8005 - RNA, 1701 nt, Artificial Sequence; identical to SEQ ID NO: 7227
  derived and/or modified CDS sequence (AUadapt) from InfluenzaA__AER08678__HA

SEQ ID NO: 8006 - RNA, 1701 nt, Artificial Sequence
  derived and/or modified CDS sequence (AUadapt) from InfluenzaA__AER08680__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccagauccucgacggcgagaacugcacccugaucgacgcccugcucggggacccccagugcgacggcuuccagaacaagaagugggaccuguucguggagcgcagccgggcgcacuccaacugcuaccccuacgacgugccggacuacgccucgcugcgcucccucgucgccagcuccggcacccuggaguucaacaacgagucguucaacuggacgggggugacccagaacggcaccuccucggccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccucggggcgcaucaccguguccaccaagcggagccagcaggccgugaucccgaacaucggcucgcgcccccggguccgcaacauccccucccggaucagcaucuacuggacgaucgugaagcccggcgacauccugcucaucaacuccaccgggaaccugaucgccccgcgcggcuacuucaagauccggucggggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 8007 - RNA, 1701 nt, Artificial Sequence
  derived and/or modified CDS sequence (AUadapt) from InfluenzaA__AER08682__HA
augaagaccgugaucgcccugucguacauccucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgucccggacuacgcgagccugcggucccucguggccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccagcgggcggaucaccguguccacgaagcgcucgcagcaggccgucaucccgaacaucggcucgcggccccgcgugcggaacauccccucccgcgugagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 8008 - RNA, 1701 nt, Artificial Sequence
  derived and/or modified CDS sequence (AUadapt) from InfluenzaA__AER08684__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucgacgugcaucacccccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 8009 - RNA, 1701 nt, Artificial Sequence
  derived and/or modified CDS sequence (AUadapt) from InfluenzaA__AER08686__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucgacgugcaucacccccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacaucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 8010 - RNA, 1701 nt, Artificial Sequence; identical to SEQ ID NO: 7227
  derived and/or modified CDS sequence (AUadapt) from InfluenzaA__AER08688__HA

SEQ ID NO: 8011 - RNA, 1701 nt, Artificial Sequence
  derived and/or modified CDS sequence (AUadapt) from InfluenzaA__AER08690__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgagaucugcaacucgccccaccagauccucgacggggagaacugcacccugaucgacgcccugcucggcgacccccagugcgacggguuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggcgugacccagaacgggaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucgggccggaucaccguguccacgaagcgcagccagcaggccgugaucccgaacaucgggucgcggccccgcguccggaacauccccucccgcgugagcaucuacuggaccaucgugaagcccggcgacauccugcucaucaacuccaccggcaaccugaucgccccgcggggguacuucaagauccgcucgggcaaguccucgaucaugcgguccgacgcccccaucgggaagugcaacagcacgugcaucacccccaacggcuccauccccaacgacaagccguuccagaacgucaaccgcaucaccuacggcgcgugcccccgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacucggagggccgggggcaggccgcggaccugaaguccacccaggccgccaucgaccagaucaacggcaagcugaaccgccucaucgggaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaagggcaacauccggugcaacaucugcaucuga

SEQ ID NO: 8012 - RNA, 1701 nt, Artificial Sequence; identical to SEQ ID NO: 7227
  derived and/or modified CDS sequence (AUadapt) from InfluenzaA__AER08692__HA

SEQ ID NO: 8013 - RNA, 1701 nt, Artificial Sequence
  derived and/or modified CDS sequence (AUadapt) from InfluenzaA__AER08698__HA
augaagaccaccaucgcccugucgcacauccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcgccggggagaucugcgacucgccccaccagauccucgacggcgagaacugcacccugaucgacgcccugcucggggacccccagugcgacggcuuccagaacaagaagugggaccuguucguggagcgcucgcgggcguacuccaacugcuaccccuacgacgugccggacuacgccagccugcgcucccucgucgccucguccggcacgcuggaguucaacaacgagagcuucaacuggaccggggugacccagaacggcaccuccucggccugcauccggcgcuccaacaacucguucuucucccggcugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccaggccagcgggcgcaucaccguguccacgaagcggucgcagcaggccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccagcaucaugcgcuccgacgcgcccaucggcaagugcaacucggagugcaucacccccaacggcuccauccccaacgacaagccguuccagaacgugaaccggaucacguacggggccugcccccgcuacgucaagcagucgacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggcggccgaccugaaguccacgcaggccgccaucgaccagaucaacgggaagcugaaccggcucaucggcaagaccaacgagaaguuccaccagaucgagaaggaguucuccgaggucgagggccgcauccaggaccuggagaaguacguggaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 8014 - RNA, 1701 nt, Artificial Sequence; identical to SEQ ID NO: 7227
  derived and/or modified CDS sequence (AUadapt) from InfluenzaA__AER08700__HA

SEQ ID NO: 8015 - RNA, 1701 nt, Artificial Sequence
  derived and/or modified CDS sequence (AUadapt) from InfluenzaA__AER92712__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucgguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugaacaagagcuacaucaacgacaagggcaaggaggugcugguccucugggggauccaccaccccuccaccucgacggaccagcagagccuguaccagaacgccgacgccuacguguucgugggcaccucccgguacucgaagaaguucaagcccgagaucgccauccgcccgaagguccggaaccaggagggccgcaugaacuacuacuggacccugguggagcccggggacaagaucaccuucgaggccacgggcaaccucguggucccccgguacgcguucaccaucgagcgcaacgccggguccggcaucaucaucucggacacccccauccacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcugguccuccuggagaacgagcggacgcuggacuaccacgacucgaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggccucgucccugguccucguggugagccugggggcgaucucguucuggaugugcuccaacggcagccugcagugccggaucugcaucuga

SEQ ID NO: 8016 - RNA, 1701 nt, Artificial Sequence; identical to SEQ ID NO: 5778
  derived and/or modified CDS sequence (AUadapt) from InfluenzaA__AET10090__HA

SEQ ID NO: 8017 - RNA, 1701 nt, Artificial Sequence; identical to SEQ ID NO: 5778
  derived and/or modified CDS sequence (AUadapt) from InfluenzaA__AET10091__HA

SEQ ID NO: 8018 - RNA, 1701 nt, Artificial Sequence; identical to SEQ ID NO: 5778
  derived and/or modified CDS sequence (AUadapt) from InfluenzaA__AET10092__HA

SEQ ID NO: 8019 - RNA, 1701 nt, Artificial Sequence
  derived and/or modified CDS sequence (AUadapt) from InfluenzaA__AET10094__HA
augaagaccaucaucgcccugucgugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccagcugcuaccccuacgacgugccggacuacgcgucccugcggucgcucgucgccuccagcggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaggccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucacguacggggcgugcccccgguacgucaagcaguccacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaccaucuaccacaagugcgacaacgccugcaucggguccauccgcaacggcaccuacgaccacaacgucuaccgggacgaggcccucaacaaccgcuuccagaucaaggggguggagcucaagucgggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 8020 - RNA, 1701 nt, Artificial Sequence
  derived and/or modified CDS sequence (AUadapt) from InfluenzaA__AET10095__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacacccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucgaguccauccgcaacgggaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 8021 - RNA, 1701 nt, Artificial Sequence
  derived and/or modified CDS sequence (AUadapt) from InfluenzaA__AET10096__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagaacucguccaccggggagaucugcgacagcccccaccagaucaucgacggcgagaacugcacccugaucgacgcccuccugggggacccccagugcgacggcuuccagaacaagaaguggaaccuguucguggagcgcuccaaggccuacucgaacugcuaccccuacgacgugccggacuacgcgucccuccggagccuggucgccuccucgggcacgcuggaguucaacaacgaguccuucaacuggaccggggugacccagaacggcaccagcuccgccugcauccgccggucgaacaacuccuucuucagccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccuccgggcggaucaccgugucgacgaagcgcucccagcaggccgugaucccgaacaucggcucgcggccccgcguccggaacauccccagccgcaucuccaucuacuggaccaucgugaagcccggcgacauccuccugaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcguggcccuccugggcuucaucaugugggcgugccagaaggggaacauccggugcaacaucugcaucuga

SEQ ID NO: 8022 - RNA, 1701 nt, Artificial Sequence
  derived and/or modified CDS sequence (AUadapt) from InfluenzaA__AET10098__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagaacucguccaccggggagaucugcgacagcccccaccagaucaucgacggcgagaacugcacccugaucgacgcccuccugggggacccccagugcgacggcuuccagaacaagaagugggaccuguucguggagcgcuccaaggccuacucgaacugcuaccccuacgacgugccggacuacgcgucccuccggagccuggucgccuccucgggcacgcuggaguucaacaacgaguccuucaacuggaccggggugacccagaacggcaccagcuccgccugcauccgccggucgaacaacuccuucuucagccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccuccgggcggaucaccgugucgacgaagcgcucccagcaggccgugaucccgaacaucggcucgcggccccgcguccggaacauccccagccgcaucuccaucuacuggaccaucgugaagcccggcgacauccuccugaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcguggcccuccugggcuucaucaugugggcgugccagaaggggaacauccggugcaacaucugcaucuga

SEQ ID NO: 8023 - RNA, 1701 nt, Artificial Sequence; identical to SEQ ID NO: 7100
  derived and/or modified CDS sequence (AUadapt) from InfluenzaA__AET10099__HA

SEQ ID NO: 8024 - RNA, 1701 nt, Artificial Sequence; identical to SEQ ID NO: 7227
  derived and/or modified CDS sequence (AUadapt) from InfluenzaA__AET10100__HA

SEQ ID NO: 8025 - RNA, 1701 nt, Artificial Sequence
  derived and/or modified CDS sequence (AUadapt) from InfluenzaA__AET10101__HA
augaagaccaucaucgcccugucgugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccggggcggacaaggaccagaucuuccuguacgcccaggccagcgggcggaucaccguguccaccaagcgcucgcagcaggccgugaucccgaacaucggcagccggccccgcguccggaacauccccucccgcaucucgaucuacuggacgaucgugaagcccggcgacauccugcucaucaacuccaccgggaaccugaucgccccgcggggcuacuucaagauccgcagcgggaaguccucgaucaugcgguccgacgcgcccaucggcaagugcaacagcgagugcaucacccccaacggcuccauccccaacgacaagccguuccagaacgugaaccgcaucaccuacggggccugcccccgguacgucaagcagucgacgcugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaccaucuaccacaagugcgacaacgccugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 8026 - RNA, 1701 nt, Artificial Sequence
  derived and/or modified CDS sequence (AUadapt) from InfluenzaA__AET10102__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccucgaccggggagaucugcgacagcccccaccagauccucgacggcaagaacugcacgcugaucgacgcccugcucggggacccccagugcgacggcuuccagaacaagaagugggaccuguucguggagcgcucgaaggccuacuccaacugcuaccccuucgacgugccggacuacgccagccugcggucccucgucgcgucguccggcacccuggaguucaacaacgagagcuucaacuggaccggggugacccagaacggcacguccucggccugcaugcgccgguccaagagcuccuucuucucgcgccugaacuggcucacccaccugaacuucaaguaccccgcccugaacgugaccaugcccaacgacgagcaguucgacaagcucuacaucuggggcguccaccaccccgggaccgacaaggaccagaucuuccuguacgcccaggcguccgggcggaucacggugagcaccaagcgcucgcagcagaccgugaucccgaacaucggcucccggccccgcauccggaacauccccagccgcaucuccaucuacuggaccaucgucaagcccggcgacauccugcucaucaacucgacggggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucaccuacggggccugcccccgguacgugaagcagaacacccugaagcucgccacgggcaugcgcaacguccccgagaagcagacccgggggaucuucggcgcgaucgccggguucaucgagaacggcugggagggcaugguggacgggugguacggcuuccgccaccagaacuccgaggggcggggccaggccgccgaccucaagagcacccaggccgcgaucgaccagaucaacgggaagcugaaccgccugaucggccggaccaacgagaaguuccaccagaucgagaaggaguucuccgagguggagggccgcauccaggaccuggagaaguacgucgaggacacgaagaucgaccuguggucguacaacgccgagcuccugguggcccuggagaaccagcacaccaucgaccucaccgacuccgagaugaacaagcuguucgagaagacccgcaagcagcugcgggagaacgccgaggacauggggaacggcugcuucaagaucuaccacaagugcgacaacgccugcaucgggagcauccgcaacggcacguacgaccacgacguguaccgggacgaggcgcucaacaaccgcuuccagaucaagggggucgagcugaaguccggcuacaaggacuggauccuguggaucucguucgccaucuccugcuuccuccugugcguggccagccugggcuucaucaugugggccugccagaaggggaacauccggugcaacaucugcaucuga

SEQ ID NO: 8027 - RNA, 1701 nt, Artificial Sequence
  derived and/or modified CDS sequence (AUadapt) from InfluenzaA__AET10103__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 8028 - RNA, 1701 nt, Artificial Sequence
  derived and/or modified CDS sequence (AUadapt) from InfluenzaA__AET10104__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagaacucguccaccggggagaucugcgacagcccccaccagaucaucgacggcgagaacugcacccugaucgacgcccuccugggggacccccagugcgacggcuuccagaacaagaagugggaccuguucguggagcgcuccaaggccuacucgaacugcuaccccuacgacgugccggacuacgcgucccuccggagccuggucgccuccucgggcacgcuggaguucaacaacgaguccuucaacuggaccggggugacccagaacggcaccagcuccgccugcauccgccggucgaacaacuccuucuucagccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccuccgggcggaucaccgugucgacgaagcgcucccagcaggccgugaucccgaacaucggcucgcggccccgcguccggaacauccccagccgcaucuccaucuacuggaccaucgugaagcccggcgacauccuccugaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggggaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcucgauccgcaacgggaccuacgaccacgacgucuaccgggacgaggcccugaacaaccgcuuccagaucaagggcguggagcugaaguccggcuacaaggacuggauccucuggaucagcuucgccaucuccugcuuccugcugugcguggcccuccugggguucaucaugugggcgugccagaagggcaacauccggugcaacaucugcaucuga

SEQ ID NO: 8029 - RNA, 1701 nt, Artificial Sequence
  derived and/or modified CDS sequence (AUadapt) from InfluenzaA__AET10105__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 8030 - RNA, 1701 nt, Artificial Sequence
  derived and/or modified CDS sequence (AUadapt) from InfluenzaA__AET10106__HA
augaagaccaucaucgcccugucguacauccucugccugguguucgcccagaagcugcccggcaacuacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8031 - RNA, 1701 nt, Artificial Sequence
  derived and/or modified CDS sequence (AUadapt) from InfluenzaA__AET10107__HA
augaagaccaucaucgcccugucguacauccucugccugguguucgcccaggagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcaacucgccccaccagauccuggacggcgagaacugcacccucaucgacgcccugcugggggacccccagugcgacggcuuccagaacaagaagugggaccucuucguggagcgcuccaaggcccacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucggggcggaucaccguguccacgaagcgcagccagcaggccgugaucccgaacaucggcucgcggccccgcguccggaacauccccucccgcgugucgaucuacuggaccaucgugaagcccggcgacauccugcugaucaacuccaccgggaaccucaucgccccgcggggcuacuucaagauccgcagcgggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccucaaguccacgcaggccgccaucgaccagaucaacgggaagcugaaccgccugaucggcaagaccaacgagaaguuccaccagaucgagaaggaguucucggagguggagggccggauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagucgggcuacaaggacuggauccuguggaucuccuucgccaucagcugcuuccugcucugcgucgcgcugcugggcuucaucaugugggccugccagaaggggaacaucaagugcaacaucugcaucuga

SEQ ID NO: 8032 - RNA, 1701 nt, Artificial Sequence; identical to SEQ ID NO: 3656
  derived and/or modified CDS sequence (AUadapt) from InfluenzaA__AET10108__HA

SEQ ID NO: 8033 - RNA, 1701 nt, Artificial Sequence; identical to SEQ ID NO: 7227
  derived and/or modified CDS sequence (AUadapt) from InfluenzaA__AET10109__HA

SEQ ID NO: 8034 - RNA, 1701 nt, Artificial Sequence
  derived and/or modified CDS sequence (AUadapt) from InfluenzaA__AET10110__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacaucaagugcaacaucugcaucuga

SEQ ID NO: 8035 - RNA, 1701 nt, Artificial Sequence
  derived and/or modified CDS sequence (AUadapt) from InfluenzaA__AET10111__HA
augaagaccaucaucgcccugucguacauccucugccugguguucgcccaggagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcaacucgccccaccagauccuggacggcgagaacugcacccucaucgacgcccugcugggggacccccagugcgacggcuuccagaacaagaagugggaccucuucguggagcgcuccaaggcccacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucggggcggaucaccguguccacgaagcgcagccagcaggccgugaucccgaacaucggcucgcggccccgcguccggaacauccccucccgcgugucgaucuacuggaccaucgugaagcccggcgacauccugcuguccaacagcaccgggaaccucaucggcccgcggggguacuucaagauccgcuccggcaagucguccaucaugcggagcgacgcccccaucggcaagugcaacuccgccugcaucacccccaacgggucgauccccaacgacaagccguuccagaacgucaaccgcaucacguacggcgcgugcccccgguacgugaagcagaacacccugaagcuggccaccgggaugcgcaacgugcccgagaagcagacccggggcaucuucggggccaucgccggcuucaucgagaacggcugggaggggauggucgacggcugguacggguuccgccaccagaacuccgagggccgggggcaggccgcggaccucaagucgacgcaggccgccaucgaccagaucaacggcaagcugaaccgccugaucggcaagaccaacgagaaguuccaccagaucgagaaggaguucuccgagguggaggggcggauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcucgauccgcaacgggaccuacgaccacgacguguaccgggacgaggcccugaacaaccgcuuccagaucaagggcguggagcucaaguccggcuacaaggacuggauccuguggaucagcuucgccaucuccugcuuccugcucugcgucgcccugcugggguucaucaugugggcgugccagaagggcaacauccggugcaacaucugcaucuga

SEQ ID NO: 8036 - RNA, 1701 nt, Artificial Sequence
  derived and/or modified CDS sequence (AUadapt) from InfluenzaA__AET10113__HA
augaagaccaucaucgcccugucguacauccucugccugguguucgcccaggagcugcccggcaacgacaacuccaccgcgacgcucugccuggggcaccacgccguccagaacggcaccaucgugaagaccaucaccaacgaccagaucgaggugacgaacgccaccgagcugguccagucguccagcaccggggagaucugcaacuccccgcaccagauccucgacggcgagaacugcacccugaucgacgcccugcucggggacccccagugcgacggcuuccagaacaagaagugggaccuguucguggagcgcucgaaggcccacuccaacugcuaccccuacgacgugcccgacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguacccggcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugauccccaacaucggcucgcggccgcgcguccggaacauccccucccgcgugucgaucuacuggaccaucgugaagcccggcgacauccugcucaucaacuccaccgggaaccugaucgcgccccggggcuacuucaagauccgcagcgggaaguccucgaucaugcgguccgacgccccgaucggcaagugcaacagcgccugcaucacccccaacggcuccauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcucaagucgggcuacaaggacuggauccuguggaucuccuucgccaucagcugcuuccugcugugcgucgcgcugcucggcuucaucaugugggccugccagaaggggaacauccggugcaacaucugcaucuga

SEQ ID NO: 8037 - RNA, 1701 nt, Artificial Sequence
  derived and/or modified CDS sequence (AUadapt) from InfluenzaA__AET10114__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgcgugcaucacccccaacggcuccaucucgaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacaucaugugcaacaucugcaucuga

SEQ ID NO: 8038 - RNA, 1698 nt, Artificial Sequence
  derived and/or modified CDS sequence (AUadapt) from InfluenzaA__AET50439__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 8039 - RNA, 1698 nt, Artificial Sequence
  derived and/or modified CDS sequence (AUadapt) from InfluenzaA__AET50440__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccacgcacaccgucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacacggagaacgccuacgugucggucgugagcucccacuacagccggaaguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 8040 - RNA, 1698 nt, Artificial Sequence
  derived and/or modified CDS sequence (AUadapt) from InfluenzaA__AET50441__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccacgcacaccgucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacacggagaacgccuacgugucggucgugagcucccacuacagccggaaguucacccccgagaucgccaagcgccccaaggugcggggccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacgcagaacgccaucaacgggaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggccaucuacucgaccguggccagcucccuggugcuccuggucagccugggcgccaucuccuucuggaugugcagcaacgggucccuccagugccggaucugcaucuga

SEQ ID NO: 8041 - RNA, 1698 nt, Artificial Sequence
  derived and/or modified CDS sequence (AUadapt) from InfluenzaA__AET50442__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacggcaucugcuaccccggccacuucgccgacuacgaggagcugcgcgagcagcucuccucgguguccagcuucgagcgguucgagaucuucccgaaggaguccagcuggcccacccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagaaggcccuguaccacaccgagaacgccuacgugagcgucgugagcucccacuacucgcggaaguucacgcccgagaucgccaagcgccccaaggugcggggccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagucgcgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcugaaccgcgagaagaucgacggcgugaagcucgaguccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 8042 - RNA, 1698 nt, Artificial Sequence
  derived and/or modified CDS sequence (AUadapt) from InfluenzaA__AET84163__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagagccucaucuccaaggagucgugguccuacaucguggagaagcccaaccccgagaacgggaccugcuaccccggccacuucgccgacuacgaggagcugcgcgagcagcugagcuccgugagcuccuucgagcgguucgagaucuucccgaaggagagcuccuggcccaaccacacggucaccggggugucggccuccugcagccacaacggcgaguccagcuucuaccgcaaccuccuguggcugaccgggaagaacggccucuaccccaaccuguccaagagcuacgccaacaacaaggagaaggaggugcugguccucuggggcgugcaccacccgcccucgaucuccaaccagaagacccuguaccacacggagaacgccuacgugagcgucguguccagccacuacucccggaaguucacccccgagguggccaagcgccccaagguccgggaccaggagggccgcaucaacuacuacuggacccugcucgagcccggcgacaccaucaucuucgaggccaacgggaaccugaucgcgccgcgguacgccuucgcccugagccgcggcuucggguccggcaucaucaacucgaacgcccccauggacaagugcgacgccaagugccagacgccccagggcgcgaucaacuccagccuccccuuccagaacgugcacccggugaccaucggggagugccccaaguacguccgguccgccaagcugcgcauggugaccggccugcggaacauccccagcauccagucccgcggccucuucggggccaucgccggguucaucgagggcggcuggaccgggaugguggacggcugguacggguaccaccaccagaacgagcagggcagcggguacgccgcggaccagaaguccacgcagaacgccaucaacggcaucaccaacaaggucaacucggugaucgagaagaugaacacccaguucaccgccgucggcaaggaguucaacaagcuggagcggcgcauggagaaccugaacaagaagguggacgacggguucaucgacaucuggacguacaacgccgagcuccuggugcugcucgagaacgagcggacccuggacuuccacgacuccaacgucaagaaccuguacgagaaggucaagagccagcucaagaacaacgccaaggagaucggcaacgggugcuucgaguucuaccacaagugcaacgacgagugcauggaguccgugaagaacggcaccuacgacuaccccaaguacagcgaggagagcaagcugaaccgcgagaagaucgacggggugaagcuggaguccaugggcguguaccagauccucgcgaucuacucgaccguggccuccagccugguccugcucgugucccugggcgccaucagcuucuggaugugcuccaacgggagccugcagugccggaucugcaucuga

SEQ ID NO: 8043 - RNA, 1698 nt, Artificial Sequence
  derived and/or modified CDS sequence (AUadapt) from InfluenzaA__AET84174__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucauccggggcuucggguccggcaucaucaacagcaacgcccccaugggcaagugcgacgccaagugccagacgccccagggggcgaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggucgggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacuccaacgucaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagucgaugggcguguaccagauccuggcgaucuacuccaccguggccagcagccugguccuccuggugucccugggggccaucagcuucuggaugugcuccaacggcagccuccagugccgcaucugcaucuga

SEQ ID NO: 8044 - RNA, 1698 nt, Artificial Sequence
  derived and/or modified CDS sequence (AUadapt) from InfluenzaA__AET84196__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagagccucaucuccaaggagucgugguccuacaucguggagaagcccaaccccgagaacgggaccugcuaccccggccacuucgccgacuacgaggagcugcgcgagcagcugagcuccgugagcuccuucgagcgguucgagaucuucccgaaggagagcuccuggcccaaccacacggucaccggggugucggccuccugcagccacaacggcgaguccagcuucuaccgcaaccuccuguggcugacccggaagaacgggcucuaccccacccuguccaagagcuacgccaacaacaaggagaaggaggugcugguccucuggggcgugcaccacccgcccucgaucaacgaccagaagacgcuguaccacaccgagaacgccuacguguccgucgugagcucccacuacagccgcaaguucacccccgagaucgccaagcggcccaaggugcgcgaccaggaggggcggaucaacuacuacuggacccugcucgagcccggcgacacgaucaucuucgaggccaacggcaaccugaucgcgccgcgcuacgccuucgcccugucccggggguucggcagcgggaucaucaacuccucggcccccauggacaagugcgacgccaagugccagacgccccagggcgcgaucaacuccagccuccccuuccagaacguccacccggugaccaucggcgagugccccaaguacgugcgcuccgccaagcugcggauggucaccgggcugcgcaacauccccagcauccagucccggggccucuucggggccaucgccggcuucaucgagggcggcuggaccggcaugguggacgggugguacggcuaccaccaccagaacgagcaggggagcggcuacgccgcggaccagaaguccacccagaacgccaucaacgggaucaccaacaaggugaacucggucaucgagaagaugaacacccaguucacggccgugggcaaggaguucaacaagcuggagcgccggauggagaaccugaacaagaaggucgacgacggcuucaucgacaucuggaccuacaacgccgagcuccuggugcugcucgagaacgagcgcacccuggacuuccacaacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcuggaguccaugggggucuaccagauccucgcgaucuacucgacgguggccuccagccuggugcugcucgucucccugggcgccaucagcuucuggaugugcuccaacggcagccugcagugccgcaucugcaucuga

SEQ ID NO: 8045 - RNA, 1698 nt, Artificial Sequence
  derived and/or modified CDS sequence (AUadapt) from InfluenzaA__AET84207__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcgugccguccuucgagcgguucgagaucuuccccaaggagagcuccuggcccaaccacacggucaccggggugagcgccuccugcucgcacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccuccaucaacgaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagccgcgggacaccaucaucuucgaggccaacggcaaccugaucgcgccccgcuacgccuucgcccucucccggggguucggcagcgggaucaucaacuccaacgcccccauggacaagugcgacgccaagugccagacgccccagggcgcgaucaacucgucccugccguuccagaacguccaccccgugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacgggaucaccaacaaggugaacucggucaucgagaagaugaacacccaguucaccgccgugggcaaggaguucaacaagcuggagcgccggauggagaaccucaacaagaaggucgacgacggcuucaucgacaucuggacguacaacgccgagcugcuggugcuccuggagaacgagcgcacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuacccgaaguacuccgaggagagcaagcugaaccgggagaagaucgacggcgugaagcucgaguccaugggggucuaccagauccuggcgaucuacucgaccguggccagcucccuggugcuccuggucagccugggcgccaucuccuucuggaugugcagcaacggcucccuccagugccgcaucugcaucuga

SEQ ID NO: 8046 - RNA, 1698 nt, Artificial Sequence
  derived and/or modified CDS sequence (AUadapt) from InfluenzaA__AET84218__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucagcaaccagaagacccuguaccacacggagaacgccuacgugagcgucguguccagccacuacucccggaaguucacccccgagaucgccaagcgccccaaggugcgggaccaggagggccgcaucaacuacuacuggacccuccuggagcccggcgacaccaucaucuucgaggccucggggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggugaagcucgagagcaugggcgucuaccagauccuggcgaucuacuccaccguggccagcucccuggugcuccuggucagccugggcgccaucuccuucuggaugugcagcaacgggucccuccagugccggaucugcaucuga

SEQ ID NO: 8047 - RNA, 1698 nt, Artificial Sequence
  derived and/or modified CDS sequence (AUadapt) from InfluenzaA__AET84229__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccacccugagcaaguccuacgccaacaacaaggagaaggaggugcucguccuguggggcgugcaccacccgcccaacaucguggaccagaagacgcuguaccggaccgagaacgccuacgucucgguggugagcucccacuacagccgcaaguucacccccgagaucgccaagcggcccaagguccgcgaccaggagggccggaucaacuacuacuggacccuccuggagcccggcgacacgaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacucgucccugcccuuccagaacgugcacccggugaccaucggcgagugccccaaguacguccgcagcgccaagcugcggauggugaccgggcuccgcaacaucccgcccauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggucaacucggugaucgagaagaugaacacccaguucacggccgucgggaaggaguucaacaagcuggagcgccggauggagaaccucaacaagaagguggacgacggcuucaucgacaucuggaccuacaacgccgagcugcuggugcuccuggagaacgagcgcacccuggacuuccacgacuccaacgucaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcguguaccagauccuggcgaucuacuccacgguggccucgagccugguccuccuggugucccugggggccaucagcuucuggaugugcuccaacggcagccuccagugccgcaucugcaucuga

SEQ ID NO: 8048 - RNA, 1698 nt, Artificial Sequence
  derived and/or modified CDS sequence (AUadapt) from InfluenzaA__AET84240__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucucgguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagucgaagcugaaccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 8049 - RNA, 1698 nt, Artificial Sequence
  derived and/or modified CDS sequence (AUadapt) from InfluenzaA__AET84251__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucgugaaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccacggggcgaucaacagcugccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggucgggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacuccaacgucaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaacaaggagaagaucgacggcgugaagcucgagucgaugggcguguaccagauccuggcgaucuacuccaccguggccagcagccugguccuccuggugucccugggggccaucagcuucuggaugugcuccaacggcagccuccagugccggaucugcaucuga

SEQ ID NO: 8050 - RNA, 1698 nt, Artificial Sequence
  derived and/or modified CDS sequence (AUadapt) from InfluenzaA__AET84262__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccacggcgcgaucaacagcugccugcccuuccagaacgugcacccggugaccaucggggagugccccaaguacguccgcuccgccaagcugcggauggugaccggccuccgcaacauccccagcauccagucccgggggcuguucggcgccaucgccggguucaucgagggcggcuggaccgggaugguggacggcugguacggguaccaccaccagaacgagcagggcucgggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacuccaacgucaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggggugaagcucgagucgaugggcguguaccagauccuggcgaucuacuccaccguggccagcagccugguccuccuggugucccugggcgccaucagcuucuggaugugcuccaacgggagccuccagugccgcaucugcaucuga

SEQ ID NO: 8051 - RNA, 1698 nt, Artificial Sequence; identical to SEQ ID NO: 7978
  derived and/or modified CDS sequence (AUadapt) from InfluenzaA__AET84284__HA

SEQ ID NO: 8052 - RNA, 1698 nt, Artificial Sequence
  derived and/or modified CDS sequence (AUadapt) from InfluenzaA__AET84306__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacaccgagaacgccuacgugagcgucgugagcucccacuacucgaucaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 8053 - RNA, 1698 nt, Artificial Sequence
  derived and/or modified CDS sequence (AUadapt) from InfluenzaA__AET84339__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagcgcagcuucuaccggaaccugcuguggcucaccgggaagaacggccuguaccccaaccuguccaagucguacgccaacaacaaggagaaggaggugcucguccuguggggcgugcaccacccgcccaacaucggcaaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucucgcggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccucgauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagucgcagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccaccguggccucgagccuggugcuccuggucucccugggggccaucagcuucuggaugugcuccaacggcagccuccagugccgcaucugcaucuga

SEQ ID NO: 8054 - RNA, 1698 nt, Artificial Sequence; identical to SEQ ID NO: 8053
  derived and/or modified CDS sequence (AUadapt) from InfluenzaA__AET84361__HA

SEQ ID NO: 8055 - RNA, 1698 nt, Artificial Sequence
  derived and/or modified CDS sequence (AUadapt) from InfluenzaA__AET84372__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagcgcagcuucuaccggaaccugcuguggcucaccgggaagaacggccuguaccccaaccuguccaagucguacgccaacaacaaggagaaggaggugcucguccuguggggcgugcaccacccgcccaacaucggcgaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucucgcggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccucgauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagucgcagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccaccguggccucgagccuggugcuccuggucucccugggggccaucagcuucuggaugugcuccaacggcagccuccagugccgcaucugcaucuga

SEQ ID NO: 8056 - RNA, 1698 nt, Artificial Sequence
  derived and/or modified CDS sequence (AUadapt) from InfluenzaA__AET84394__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagcgcagcuucuaccggaaccugcuguggcucaccgggaagaacggccuguaccccaaccuguccaagucguacgccaacaacaaggagaaggaggugcucguccuguggggcgugcaccacccgcccgacaucggcaaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucucgcggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgagaagcugcggauggucaccgggcuccgcaacauccccucgauccagucccggggccuguucggggccaucgccggcuucaucgagggcggguggaccggcaugguggacgggugguacggcuaccaccaccagaacgagcaggggagcggcuacgccgccgaccagaaguccacgcagaacgcgaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagucgcagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggccaucuacuccaccguggcgucgagccuggugcuccuggucucccugggggccaucagcuucuggaugugcuccaacggcagccuccagugccgcaucugcaucuga

SEQ ID NO: 8057 - RNA, 1698 nt, Artificial Sequence; identical to SEQ ID NO: 5761
  derived and/or modified CDS sequence (AUadapt) from InfluenzaA__AET84405__HA

SEQ ID NO: 8058 - RNA, 1698 nt, Artificial Sequence
  derived and/or modified CDS sequence (AUadapt) from InfluenzaA__AET84416__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagcgcagcuucuaccggaaccugcuguggcucaccgggaagaacggccuguaccccacccuguccaagucguacgccaacaacaaggagaaggaggugcucguccuguggggcgugcaccacccgcccgacaucggcgaccagaagacgcuguaccacaccgagaacgccuacguguccgucgugagcagccacuacucccgcaaguucacccccgagaucgccaagcggcccaaggugcgcgaccaggagggccggaucaacuacuacuggacccuccuggagcccggggacacgaucaucuucgaggccaacggcaaccugaucgcgccgcgcuacgccuucgcccucucgcggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccucgauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacuccaacgugaagaaccucuacgagaaggucaagucgcagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccacgguggccucgagccuggugcuccuggucucccugggggccaucagcuucuggaugugcuccaacggcagccuccagugccgcaucugcaucuga

SEQ ID NO: 8059 - RNA, 1698 nt, Artificial Sequence
  derived and/or modified CDS sequence (AUadapt) from InfluenzaA__AET84427__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacucgaccguggccagcucccuggugcuccuggucagccugggggccaucuccuucuggaugugcagcaacggcucccuccagugccggaucugcaucuga

SEQ ID NO: 8060 - RNA, 1698 nt, Artificial Sequence
  derived and/or modified CDS sequence (AUadapt) from InfluenzaA__AET84438__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaagacccuguacaacacggagaacgccuacgucagcguggugagcucccacuacucgcggaaguucacccccgagaucgccaagcgccccaagguccgggaccaggagggccgcaucaacuacuacuggacccuccuggagcccggggacaccaucauguucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 8061 - RNA, 1698 nt, Artificial Sequence
  derived and/or modified CDS sequence (AUadapt) from InfluenzaA__AET84449__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccucguggcccaaccacacgaccaccggggucuccgccagcugcucccacaacggcgagagcuccuucuacaagaaccugcuguggcucaccgggaagaacggccuguaccccaaccugucgaaguccuacgccaacaacaaggagaaggaggugcucgugcuguggggcguccaccacccgcccaacaucggcgaccagcgggcccuguaccacacggagaacgccuacgugagcguggucagcucccacuacucgcgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgggugcgacgcgaagugccagacgccccagggcgccaucaacagcucccugcccuuccagaacgugcacccggucaccaucggggagugccccaaguacgugcgcucggccaagcugcggauggugaccggccuccgcaacauccccuccauccagagccgggggcuguucggcgccaucgccggcuucaucgagggcggguggaccgggauggucgacggcugguacggguaccaccaccagaacgagcagggcuccggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacucgaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgggagaagaucgacggcgugaagcucgaguccauggggguguaccagauccuggccaucuacucgaccgucgccagcucccuggugcuccuggugagccugggcgccaucuccuucuggaugugcagcaacgggucccuccagugccgcaucugcaucuga

SEQ ID NO: 8062 - RNA, 1701 nt, Artificial Sequence
  derived and/or modified CDS sequence (AUadapt) from InfluenzaA__AET98600__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccguccccaacaacgagcaguucgacaagcucuacaucuggggcgugcaccaccccgggaccgacaaggaccagaucuuccuguacgcgcaggccagcgggcggaucaccguguccacgaagcgcucgcagcaggccgucaucccgaacaucggcagccggccccgcgugcggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgucaaccgcaucacguacggggcgugcccccgguacgugaagcagucgacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgcggaggacauggggaacggcugcuucaccaucuaccacaagugcgacaacgccugcaucgggucgauccgcaacggcaccuacgaccacaacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggcgugccagaaggggaacauccggugcaacaucugcaucuga

SEQ ID NO: 8063 - RNA, 1701 nt, Artificial Sequence
  derived and/or modified CDS sequence (AUadapt) from InfluenzaA__AEV76874__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucguucuccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccucgaccacggccgaccagcagagccucuaccagaacgccgacaccuacguguucgugggcaccucccgguacucgaagaaguucaaccccgagaucgagauccgcccgaagguccgggaccaggaggggcgcaugaacuacuacuggacccugguggagcccggcgacaagaucacguucgaggccaccgggaaccugguggucccccgguacgccuucgcgauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagucgcggggccuguucggggccaucgcgggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggguuccuggacaucuggaccuacaacgcggagcuccuggugcugcucgagaacgagcggacgcuggacuaccacgacucgaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacucgaccgucgccuccagccuggugcugguggucucccucggcgcgaucucguucuggaugugcagcaacggcucccugcagugccggaucugcaucuga

SEQ ID NO: 8064 - RNA, 1701 nt, Artificial Sequence; identical to SEQ ID NO: 116
  derived and/or modified CDS sequence (AUadapt) from InfluenzaA__AEW10574__HA

SEQ ID NO: 8065 - RNA, 1701 nt, Artificial Sequence; identical to SEQ ID NO: 116
  derived and/or modified CDS sequence (AUadapt) from InfluenzaA__AEW10584__HA

SEQ ID NO: 8066 - RNA, 1701 nt, Artificial Sequence; identical to SEQ ID NO: 3267
  derived and/or modified CDS sequence (AUadapt) from InfluenzaA__AEW10594__HA

SEQ ID NO: 8067 - RNA, 1701 nt, Artificial Sequence; identical to SEQ ID NO: 3267
  derived and/or modified CDS sequence (AUadapt) from InfluenzaA__AEW10604__HA

SEQ ID NO: 8068 - RNA, 1701 nt, Artificial Sequence; identical to SEQ ID NO: 3267
  derived and/or modified CDS sequence (AUadapt) from InfluenzaA__AEW10614__HA

SEQ ID NO: 8069 - RNA, 1701 nt, Artificial Sequence; identical to SEQ ID NO: 3267
  derived and/or modified CDS sequence (AUadapt) from InfluenzaA__AEW10624__HA

SEQ ID NO: 8070 - RNA, 1701 nt, Artificial Sequence; identical to SEQ ID NO: 116
  derived and/or modified CDS sequence (AUadapt) from InfluenzaA__AEW10634__HA

SEQ ID NO: 8071 - RNA, 1701 nt, Artificial Sequence; identical to SEQ ID NO: 62
  derived and/or modified CDS sequence (AUadapt) from InfluenzaA__AEW10644__HA

SEQ ID NO: 8072 - RNA, 1701 nt, Artificial Sequence
  derived and/or modified CDS sequence (AUadapt) from InfluenzaA__AEW10654__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 8073 - RNA, 1701 nt, Artificial Sequence; identical to SEQ ID NO: 62
  derived and/or modified CDS sequence (AUadapt) from InfluenzaA__AEW10664__HA

SEQ ID NO: 8074 - RNA, 1701 nt, Artificial Sequence
  derived and/or modified CDS sequence (AUadapt) from InfluenzaA__AEW10674__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccgaggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 8075 - RNA, 1701 nt, Artificial Sequence; identical to SEQ ID NO: 116
  derived and/or modified CDS sequence (AUadapt) from InfluenzaA__AEW10684__HA

SEQ ID NO: 8076 - RNA, 1701 nt, Artificial Sequence; identical to SEQ ID NO: 62
  derived and/or modified CDS sequence (AUadapt) from InfluenzaA__AEW10694__HA

SEQ ID NO: 8077 - RNA, 1701 nt, Artificial Sequence; identical to SEQ ID NO: 62
  derived and/or modified CDS sequence (AUadapt) from InfluenzaA__AEW10704__HA

SEQ ID NO: 8078 - RNA, 1701 nt, Artificial Sequence; identical to SEQ ID NO: 8072
  derived and/or modified CDS sequence (AUadapt) from InfluenzaA__AEW10724__HA

SEQ ID NO: 8079 - RNA, 1701 nt, Artificial Sequence; identical to SEQ ID NO: 116
  derived and/or modified CDS sequence (AUadapt) from InfluenzaA__AEW10734__HA

SEQ ID NO: 8080 - RNA, 1701 nt, Artificial Sequence
  derived and/or modified CDS sequence (AUadapt) from InfluenzaA__AEW10744__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccugucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 8081 - RNA, 1701 nt, Artificial Sequence; identical to SEQ ID NO: 8080
  derived and/or modified CDS sequence (AUadapt) from InfluenzaA__AEW10754__HA

SEQ ID NO: 8082 - RNA, 1701 nt, Artificial Sequence
  derived and/or modified CDS sequence (AUadapt) from InfluenzaA__AEW10764__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccaacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 8083 - RNA, 1701 nt, Artificial Sequence; identical to SEQ ID NO: 3158
  derived and/or modified CDS sequence (AUadapt) from InfluenzaA__AEW10774__HA

SEQ ID NO: 8084 - RNA, 1701 nt, Artificial Sequence; identical to SEQ ID NO: 62
  derived and/or modified CDS sequence (AUadapt) from InfluenzaA__AEW10784__HA

SEQ ID NO: 8085 - RNA, 1701 nt, Artificial Sequence; identical to SEQ ID NO: 62
  derived and/or modified CDS sequence (AUadapt) from InfluenzaA__AEW10794__HA

SEQ ID NO: 8086 - RNA, 1701 nt, Artificial Sequence; identical to SEQ ID NO: 96
  derived and/or modified CDS sequence (AUadapt) from InfluenzaA__AEW10804__HA

SEQ ID NO: 8087 - RNA, 1701 nt, Artificial Sequence; identical to SEQ ID NO: 53
  derived and/or modified CDS sequence (AUadapt) from InfluenzaA__AEW10814__HA

SEQ ID NO: 8088 - RNA, 1701 nt, Artificial Sequence; identical to SEQ ID NO: 3005
  derived and/or modified CDS sequence (AUadapt) from InfluenzaA__AEW10824__HA

SEQ ID NO: 8089 - RNA, 1701 nt, Artificial Sequence; identical to SEQ ID NO: 62
  derived and/or modified CDS sequence (AUadapt) from InfluenzaA__AEW10834__HA

SEQ ID NO: 8090 - RNA, 1701 nt, Artificial Sequence; identical to SEQ ID NO: 96
  derived and/or modified CDS sequence (AUadapt) from InfluenzaA__AEW10844__HA

SEQ ID NO: 8091 - RNA, 1701 nt, Artificial Sequence
  derived and/or modified CDS sequence (AUadapt) from InfluenzaA__AEW10854__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucacgauccgcccgaagguccgggaccaggagggccgcaugaacuacuacuggacccugguggagcccggggacaagaucaccuucgaggccaccggcaaccugguggucccccgguacgcguucgccauggagcgcaacgccgggucgggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggccaccggccuccgcaacgucccgucgauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacucggucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacagcaccgucgcgucgucccuggugcugguggucagccucggggccaucuccuucuggaugugcagcaacggcucccugcagugccggaucugcaucuga

SEQ ID NO: 8092 - RNA, 1701 nt, Artificial Sequence; identical to SEQ ID NO: 96
  derived and/or modified CDS sequence (AUadapt) from InfluenzaA__AEW10864__HA

SEQ ID NO: 8093 - RNA, 1701 nt, Artificial Sequence; identical to SEQ ID NO: 96
  derived and/or modified CDS sequence (AUadapt) from InfluenzaA__AEW10874__HA

SEQ ID NO: 8094 - RNA, 1701 nt, Artificial Sequence; identical to SEQ ID NO: 96
  derived and/or modified CDS sequence (AUadapt) from InfluenzaA__AEW10884__HA

SEQ ID NO: 8095 - RNA, 1701 nt, Artificial Sequence; identical to SEQ ID NO: 62
  derived and/or modified CDS sequence (AUadapt) from InfluenzaA__AEW10894__HA

SEQ ID NO: 8096 - RNA, 1701 nt, Artificial Sequence; identical to SEQ ID NO: 96
  derived and/or modified CDS sequence (AUadapt) from InfluenzaA__AEW10904__HA

SEQ ID NO: 8097 - RNA, 1701 nt, Artificial Sequence; identical to SEQ ID NO: 96
  derived and/or modified CDS sequence (AUadapt) from InfluenzaA__AEW10914__HA

SEQ ID NO: 8098 - RNA, 1701 nt, Artificial Sequence; identical to SEQ ID NO: 62
  derived and/or modified CDS sequence (AUadapt) from InfluenzaA__AEW10924__HA

SEQ ID NO: 8099 - RNA, 1701 nt, Artificial Sequence; identical to SEQ ID NO: 62
  derived and/or modified CDS sequence (AUadapt) from InfluenzaA__AEW10934__HA

SEQ ID NO: 8100 - RNA, 1701 nt, Artificial Sequence; identical to SEQ ID NO: 96
  derived and/or modified CDS sequence (AUadapt) from InfluenzaA__AEW10944__HA

SEQ ID NO: 8101 - RNA, 1701 nt, Artificial Sequence; identical to SEQ ID NO: 116
  derived and/or modified CDS sequence (AUadapt) from InfluenzaA__AEW10954__HA

SEQ ID NO: 8102 - RNA, 1701 nt, Artificial Sequence; identical to SEQ ID NO: 116
  derived and/or modified CDS sequence (AUadapt) from InfluenzaA__AEW10964__HA

SEQ ID NO: 8103 - RNA, 1701 nt, Artificial Sequence; identical to SEQ ID NO: 96
  derived and/or modified CDS sequence (AUadapt) from InfluenzaA__AEW10974__HA

SEQ ID NO: 8104 - RNA, 1701 nt, Artificial Sequence; identical to SEQ ID NO: 116
  derived and/or modified CDS sequence (AUadapt) from InfluenzaA__AEW10984__HA

SEQ ID NO: 8105 - RNA, 1701 nt, Artificial Sequence; identical to SEQ ID NO: 116
  derived and/or modified CDS sequence (AUadapt) from InfluenzaA__AEW10994__HA

SEQ ID NO: 8106 - RNA, 1701 nt, Artificial Sequence; identical to SEQ ID NO: 116
  derived and/or modified CDS sequence (AUadapt) from InfluenzaA__AEW11004__HA

SEQ ID NO: 8107 - RNA, 1701 nt, Artificial Sequence; identical to SEQ ID NO: 116
  derived and/or modified CDS sequence (AUadapt) from InfluenzaA__AEW11014__HA

SEQ ID NO: 8108 - RNA, 1701 nt, Artificial Sequence; identical to SEQ ID NO: 116
  derived and/or modified CDS sequence (AUadapt) from InfluenzaA__AEW11024__HA

SEQ ID NO: 8109 - RNA, 1701 nt, Artificial Sequence; identical to SEQ ID NO: 116
  derived and/or modified CDS sequence (AUadapt) from InfluenzaA__AEW11034__HA

SEQ ID NO: 8110 - RNA, 1701 nt, Artificial Sequence; identical to SEQ ID NO: 96
  derived and/or modified CDS sequence (AUadapt) from InfluenzaA__AEW11044__HA

SEQ ID NO: 8111 - RNA, 1701 nt, Artificial Sequence; identical to SEQ ID NO: 116
  derived and/or modified CDS sequence (AUadapt) from InfluenzaA__AEW11054__HA

SEQ ID NO: 8112 - RNA, 1701 nt, Artificial Sequence; identical to SEQ ID NO: 62
  derived and/or modified CDS sequence (AUadapt) from InfluenzaA__AEW11064__HA

SEQ ID NO: 8113 - RNA, 1701 nt, Artificial Sequence; identical to SEQ ID NO: 62
  derived and/or modified CDS sequence (AUadapt) from InfluenzaA__AEW11074__HA

SEQ ID NO: 8114 - RNA, 1701 nt, Artificial Sequence
  derived and/or modified CDS sequence (AUadapt) from InfluenzaA__AEW11084__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugccugcacgccggcgcgaaguccuucuacaagaaccucaucuggcuggugaagaaggggaacucguacccgaagcuguccaagagcuacaucaacgacaagggcaaggaggugcucguccugugggggauccaccaccccucgaccuccgccgaccagcagagccuguaccagaacgccgacgccuacguguucgugggcuccucgcgguacuccaagaaguucaagcccgagaucgccauccgccccaagguccgggaccaggagggccgcaugaacuacuacuggacgcucguggagccgggggacaagaucaccuucgaggcgaccggcaaccugguggucccccgguacgccuucgccauggagcgcaacgccgggagcggcaucaucaucuccgacacccccgugcacgacugcaacacgaccugccagacccccaagggcgccaucaacaccucgcugccguuccagaacauccaccccaucacgaucgggaagugccccaaguacgugaaguccaccaagcuccggcuggcgaccggccugcgcaacguccccagcauccagucccggggccucuucggggccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcucaaccgggaggagaucgacggcgugaagcuggaguccacccgcaucuaccagauccuggcgaucuacagcaccgucgccucgucccucgugcugguggucagccugggggccaucuccuucuggaugugcagcaacggcucccuccagugccggaucugcaucuga

SEQ ID NO: 8115 - RNA, 1701 nt, Artificial Sequence; identical to SEQ ID NO: 62
  derived and/or modified CDS sequence (AUadapt) from InfluenzaA__AEW11094__HA

SEQ ID NO: 8116 - RNA, 1701 nt, Artificial Sequence; identical to SEQ ID NO: 62
  derived and/or modified CDS sequence (AUadapt) from InfluenzaA__AEW11104__HA

SEQ ID NO: 8117 - RNA, 1701 nt, Artificial Sequence; identical to SEQ ID NO: 116
  derived and/or modified CDS sequence (AUadapt) from InfluenzaA__AEW11114__HA

SEQ ID NO: 8118 - RNA, 1701 nt, Artificial Sequence
  derived and/or modified CDS sequence (AUadapt) from InfluenzaA__AEW11124__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguucgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 8119 - RNA, 1701 nt, Artificial Sequence
  derived and/or modified CDS sequence (AUadapt) from InfluenzaA__AEW11134__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaacaaggaggagaucgacggcgugaagcuggaguccacccggaucuaccagauccucgcgaucuacagcaccgucgccucgucccuggugcugguggucagccucggggccaucuccuucuggaugugcagcaacggcucccugcagugccgcaucugcaucuga

SEQ ID NO: 8120 - RNA, 1701 nt, Artificial Sequence; identical to SEQ ID NO: 116
  derived and/or modified CDS sequence (AUadapt) from InfluenzaA__AEW11144__HA

SEQ ID NO: 8121 - RNA, 1701 nt, Artificial Sequence; identical to SEQ ID NO: 116
  derived and/or modified CDS sequence (AUadapt) from InfluenzaA__AEW11154__HA

SEQ ID NO: 8122 - RNA, 1701 nt, Artificial Sequence; identical to SEQ ID NO: 8114
  derived and/or modified CDS sequence (AUadapt) from InfluenzaA__AEW11164__HA

SEQ ID NO: 8123 - RNA, 1701 nt, Artificial Sequence; identical to SEQ ID NO: 8114
  derived and/or modified CDS sequence (AUadapt) from InfluenzaA__AEW11174__HA

SEQ ID NO: 8124 - RNA, 1701 nt, Artificial Sequence; identical to SEQ ID NO: 116
  derived and/or modified CDS sequence (AUadapt) from InfluenzaA__AEW11184__HA

SEQ ID NO: 8125 - RNA, 1701 nt, Artificial Sequence; identical to SEQ ID NO: 62
  derived and/or modified CDS sequence (AUadapt) from InfluenzaA__AEW11194__HA

SEQ ID NO: 8126 - RNA, 1701 nt, Artificial Sequence; identical to SEQ ID NO: 116
  derived and/or modified CDS sequence (AUadapt) from InfluenzaA__AEW11204__HA

SEQ ID NO: 8127 - RNA, 1701 nt, Artificial Sequence; identical to SEQ ID NO: 116
  derived and/or modified CDS sequence (AUadapt) from InfluenzaA__AEW11214__HA

SEQ ID NO: 8128 - RNA, 1701 nt, Artificial Sequence; identical to SEQ ID NO: 96
  derived and/or modified CDS sequence (AUadapt) from InfluenzaA__AEW11224__HA

SEQ ID NO: 8129 - RNA, 1701 nt, Artificial Sequence; identical to SEQ ID NO: 116
  derived and/or modified CDS sequence (AUadapt) from InfluenzaA__AEW11234__HA

SEQ ID NO: 8130 - RNA, 1701 nt, Artificial Sequence; identical to SEQ ID NO: 116
  derived and/or modified CDS sequence (AUadapt) from InfluenzaA__AEW11244__HA

SEQ ID NO: 8131 - RNA, 1701 nt, Artificial Sequence
  derived and/or modified CDS sequence (AUadapt) from InfluenzaA__AEW11254__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugccugcacgccggcgcgaaguccuucuacaagaaccucaucuggcuggugaagaaggggaacagcuacccgaagcuguccaagucguacaucaacgacaagggcaaggaggugcucguccugugggggauccaccaccccagcgccuccgccgaccagcagucgcuguaccagaacgccgacgccuacguguucgugggcuccagccgguacuccaagaaggucaagcccgagaucgcgauccgccccaaggugcgggaccaggagggccgcaugaacuacuacuggacccucguggagccgggggacaagaucacguucgaggccaccggcaaccuggucgugccccgguacgccuucgccauggagcgcaacgccgggucgggcaucaucaucuccgacacccccgugcacgacugcaacaccacgugccagacccccaagggcgcgaucaacaccagccugccguuccagaacauccaccccaucaccaucgggaagugccccaaguacgucaaguccacgaagcuccggcuggccaccggccugcgcaacgugcccucgauccagucccggggccucuucggggccaucgccggguucaucgagggcggcuggaccgggaugguggacggcugguacggguaccaccaccagaacgagcagggcagcggguacgccgcggaccugaaguccacccagaacgccaucgacgagaucacgaacaaggucaacucggugaucgagaagaugaacacccaguucaccgccgucggcaaggaguucaaccaccuggagaagcgcaucgagaaccucaacaagaagguggacgacggcuuccuggacaucuggaccuacaacgccgagcugcucgugcugcuggagaacgagcggacgcucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuacccgaaguacucggaggaggcgaagcucaaccgggaggagaucgacggcgucaagcuggaguccacccgcaucuaccagauccuggccaucuacagcaccguggccucgucccucgugcuggucgugagccugggggccaucuccuucuggaugugcagcaacggcucccuccagugccggaucugcaucuga

SEQ ID NO: 8132 - RNA, 1701 nt, Artificial Sequence; identical to SEQ ID NO: 62
  derived and/or modified CDS sequence (AUadapt) from InfluenzaA__AEW11263__HA

SEQ ID NO: 8133 - RNA, 1701 nt, Artificial Sequence; identical to SEQ ID NO: 62
  derived and/or modified CDS sequence (AUadapt) from InfluenzaA__AEW11273__HA

SEQ ID NO: 8134 - RNA, 1701 nt, Artificial Sequence; identical to SEQ ID NO: 62
  derived and/or modified CDS sequence (AUadapt) from InfluenzaA__AEW11283__HA

SEQ ID NO: 8135 - RNA, 1701 nt, Artificial Sequence; identical to SEQ ID NO: 62
  derived and/or modified CDS sequence (AUadapt) from InfluenzaA__AEW11293__HA

SEQ ID NO: 8136 - RNA, 1701 nt, Artificial Sequence
  derived and/or modified CDS sequence (AUadapt) from InfluenzaA__AEW11303__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccgggugugcaucuga

SEQ ID NO: 8137 - RNA, 1701 nt, Artificial Sequence; identical to SEQ ID NO: 62
  derived and/or modified CDS sequence (AUadapt) from InfluenzaA__AEW11313__HA

SEQ ID NO: 8138 - RNA, 1701 nt, Artificial Sequence
  derived and/or modified CDS sequence (AUadapt) from InfluenzaA__AEW11323__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccgugaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggucaagcucgagagcacccgcaucuaccagauccuggcgaucuacuccaccguggccucgagccuggugcucgucgugucccugggcgccaucucguucuggaugugcuccaacggcagccugcagugccggaucugcaucuga

SEQ ID NO: 8139 - RNA, 1701 nt, Artificial Sequence
  derived and/or modified CDS sequence (AUadapt) from InfluenzaA__AEW22712__HA
augaaggccauccuggugguccuccuguacaccuucgccaccgcgaacgccgacacgcugugcaucggcuaccacgccaacaacucgaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaagggguucuacaagaaccugaucuggcucgucaagaagggcaacuccuaccccaagcugucgaaguccuacaucaacgacaaggggaaggaggugcuggugcucuggggcauccaccaccccagcaccacggccgaccagcagucgcuguaccagaacgccgacaccuacgucuucgugggcaccucccgguacagcaagaaguucaagcccgagaucgccauccgcccgaaggugcgggaccaggaggggcgcaugaacuacuacuggacccuggucaagcccggcgacaagaucacguucgaggccaccgggaaccucguggugccccgguacgcguucgccauggagcgcaacgccggcuccggcaucaucaucucggacacccccguccacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgugaucgagaagaugaacacccaguucaccgcggucggcaaggaguucaaccaccuggagaagcgcaucgagaaccugaacaagaagguggacgacggguuccucgacaucuggaccuacaacgccgagcugcugguccuccuggagaacgagcggacgcuggacuaccacgacagcaacgugaagaaccucuacgagaaggugcgcaaccagcugaagaacaacgccaaggagaucggcaacgggugcuucgaguucuaccacaagugcgacaacacgugcauggaguccgucaagaacggcaccuacgacuaccccaaguacucggaggaggccaagcugaaccgggaggagaucgacggggugaagcucgaguccacccgcaucuaccagauccuggccaucuacucgaccguggcguccagccugguccucguggugucccugggcgccaucucguucuggaugugcagcaacggcucccugcagugccggaucugcaucuga

SEQ ID NO: 8140 - RNA, 1701 nt, Artificial Sequence
  derived and/or modified CDS sequence (AUadapt) from InfluenzaA__AEW22718__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccuggugaagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 8141 - RNA, 1701 nt, Artificial Sequence; identical to SEQ ID NO: 6699
  derived and/or modified CDS sequence (AUadapt) from InfluenzaA__AEW22720__HA

SEQ ID NO: 8142 - RNA, 1701 nt, Artificial Sequence; identical to SEQ ID NO: 6699
  derived and/or modified CDS sequence (AUadapt) from InfluenzaA__AEW22722__HA

SEQ ID NO: 8143 - RNA, 1701 nt, Artificial Sequence
  derived and/or modified CDS sequence (AUadapt) from InfluenzaA__AEW22724__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgcccgggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggccaucuacucgaccgucgcguccagccuggugcucguggucucccugggcgccaucucguucuggaugugcagcaacggcucccugcagugccgcaucugcaucuga

SEQ ID NO: 8144 - RNA, 1701 nt, Artificial Sequence
  derived and/or modified CDS sequence (AUadapt) from InfluenzaA__AEW25297__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggaucccggggaaccccgagugcgagucgcuguccaccgcgagcuccuggucguacaucguggagaccuccagcuccgacaacggcacgugcuaccccggcgacuucaucgacuacgaggagcugcgggagcagcucucguccgugucguccuucgagcgcuucgagaucuuccccaagaccagcuccuggccgaaccacgaccccaacaagggggucaccgccgccugcccccacgccggcgccaagucguucuacaagaaccugaucuggcuggugaagaaggggaacuccuaccccaagcucagcaaguccuacaucaacgacaagggcaaggaggugcugguccugugggggauccaccacccgucgaccagcgccgaccagcagucccucuaccagaacgccgacgccuacguguucgugggcacgucgcgguacuccaagaaguucaagcccgagaucgccauccgccccaagguccgggaccaggagggccgcaugaacuacuacuggacccugguggagcccggggacaagaucaccuucgaggcgaccggcaaccugguggucccgcgguacgccuucgccauggagcgcaacgccgggucgggcaucaucaucuccgacacgcccgugcacgacugcaacacgaccugccagacgccccggggcgccaucaacaccagccuccccuuccagaacauccacccgaucaccaucgggaagugccccaaguacgugaaguccaccaagcugcgccuggcgaccggccuccggaacguccccucgauccagucccgcgggcuguucggcgccaucgccggguucaucgagggcggcuggaccgggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgugaagaaccuguacgagaagguccggucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcuggaguccacccggaucuaccagauccucgcgaucuacucgaccgucgccuccagccuggugcugguggucucgcucggggccaucuccuucuggaugugcagcaacggcucccugcagugccgcaucugcaucuga

SEQ ID NO: 8145 - RNA, 1701 nt, Artificial Sequence; identical to SEQ ID NO: 3712
  derived and/or modified CDS sequence (AUadapt) from InfluenzaA__AEW25306__HA

SEQ ID NO: 8146 - RNA, 1701 nt, Artificial Sequence
  derived and/or modified CDS sequence (AUadapt) from InfluenzaA__AEW25315__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucugggugugcagcaacggcucccugcagugccggaucugcaucuga

SEQ ID NO: 8147 - RNA, 1701 nt, Artificial Sequence
  derived and/or modified CDS sequence (AUadapt) from InfluenzaA__AEW25331__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccucguccagcgacaacggcacgugcuaccccggcgacuucaucgacuacgaggagcugcgggagcagcucuccucgguguccagcuucgagcgcuucgagaucuuccccaagaccuccagcuggcccaaccacgacuccaacaagggggucaccgccgccugcccgcacgccggcgccaagucguucuacaagaaccugaucuggcuggugaagaaggggaacuccuaccccaagcucagcaagucguacaucaacgacaagggcaaggaggugcugguccugugggggauccaccaccccuccaccagcgcggaccagcagucccucuaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccucgcuccccuuccagaacaucccgcccaucaccaucgggaagugccccaaguacgugaaguccaccaagcugcggcuggccaccggccuccgcaacguccccagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacucggucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacagcaccgucgcgucgucccuggugcugguggucagccucggggccaucuccuucuggaugugcagcaacggcucccugcagugccggaucugcaucuga

SEQ ID NO: 8148 - RNA, 1701 nt, Artificial Sequence
  derived and/or modified CDS sequence (AUadapt) from InfluenzaA__AEW25349__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccucguccagcgacaacggcacgugcuaccccggcgacuucaucgacuacgaggagcugcgggagcagcucuccucgguguccagcuucgagcgcuucgagaucuuccccaagaccuccagcuggcccaaccacgacuccaacaagggggucaccgccgccugcccgcacgccggcgccaagucguucuacaagaaccugaucuggcuggugaagaaggggaacuccuaccccaagcucagcaagucguacaucaacgacaagggcaaggaggugcugguccugugggggauccaccaccccuccaccagcgcggaccagcagucccucuaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccucgcuccccuuccagaacauccaccccaucaccaucgggaagugccccaaguacgugaaguccaccaagcugcggcuggccaccggccuccgcaacgucccgagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacucggucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacagcaccgucgcgucgucccuggugcugguggucagccucggggccaucuccuucuggaugugcagcaacggcucccugcagugccggaucugcaucuga

SEQ ID NO: 8149 - RNA, 1701 nt, Artificial Sequence
  derived and/or modified CDS sequence (AUadapt) from InfluenzaA__AEW25367__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccucguccagcgacaacggcacgugcuaccccggcgacuucaucgacuacgaggagcugcgggagcagcucuccucgguguccagcuucgagcgcuucgagaucuuccccaagaccuccucguggcccaaccacgacuccaacaagggggucaccgccgccugcccgcacgccggcgccaagagcuucuacaagaaccugaucuggcuggugaagaaggggaacuccuaccccaagcucucgaagagcuacaucaacgacaagggcaaggaggugcugguccugugggggauccaccaccccuccaccucggcggaccagcagcggcucuaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggccaccggcaaccugguggucccccgcuacgcguucgccauggagcggaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcgccuggccaccggccuccggaacgugccguccauccagucgcgcgggcuguucggcgcgaucgccggguucaucgagggcggcuggacggggaugguggacggcugguacggguaccaccaccagaacgagcagggcuccggguacaccgccgaccucaagagcacccagaacgccaucgacgagaucaccaacaaggugaacuccgucaucgagaagaugaacacgcaguucaccgccgugggcaaggaguucaaccaccuggagaagcggaucgagaaccugaacaagaaggucgacgacggcuuccuggacaucuggaccuacaacgcggagcuccuggugcugcucgagaacgagcgcacccuggacuaccacgacucgaacgugaagaaccuguacgagaagguccggucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagucgacccggaucuaccagauccucgccaucuacuccaccgucgccagcucgcuggugcugguggucucccucggggcgaucagcuucuggaugugcuccaacggcagccugcagugccgcaucugcaucuga

SEQ ID NO: 8150 - RNA, 1701 nt, Artificial Sequence
  derived and/or modified CDS sequence (AUadapt) from InfluenzaA__AEW25377__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagucccagcugaagaacaacgccaaggagaucgggaacggcugcuucgaguucuaccacaagugcgacaacgccugcauggagucggugaagaacgggacguacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 8151 - RNA, 1701 nt, Artificial Sequence
  derived and/or modified CDS sequence (AUadapt) from InfluenzaA__AEW25385__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugcccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 8152 - RNA, 1701 nt, Artificial Sequence; identical to SEQ ID NO: 8148
  derived and/or modified CDS sequence (AUadapt) from InfluenzaA__AEW25416__HA

SEQ ID NO: 8153 - RNA, 1701 nt, Artificial Sequence
  derived and/or modified CDS sequence (AUadapt) from InfluenzaA__AEW25446__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacaagcaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 8154 - RNA, 1701 nt, Artificial Sequence; identical to SEQ ID NO: 8148
  derived and/or modified CDS sequence (AUadapt) from InfluenzaA__AEW25454__HA

SEQ ID NO: 8155 - RNA, 1701 nt, Artificial Sequence
  derived and/or modified CDS sequence (AUadapt) from InfluenzaA__AEW25462__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugucgaagcccuacaccaacgacaagggcaaggaggugcugguccucugggggauccaccacccguccacgagcgccgaccagcagucgcuguaccagaacgccgacgccuacguguucgugggcaccucccgguacucgaagaaguucaagcccgagaucgccauccgccccaagguccgggaccaggagggccgcaugaacuacuacuggacccugguggagcccggggacaagaucaccuucgaggcgacgggcaaccucguggucccgcgguacgccuucgccauggagcgcaacgccggguccggcaucaucaucagcgacacccccgugcacgacugcaacacgaccugccagacccccaagggcgccaucaacaccucccugcccuuccagaacauccacccgaucaccaucgggaagugccccaaguacgucaagucgaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 8156 - RNA, 1701 nt, Artificial Sequence; identical to SEQ ID NO: 3712
  derived and/or modified CDS sequence (AUadapt) from InfluenzaA__AEW25472__HA

SEQ ID NO: 8157 - RNA, 1701 nt, Artificial Sequence
  derived and/or modified CDS sequence (AUadapt) from InfluenzaA__AEW25482__HA
augaaggccauccuggugguccuccuguacaccuucgccaccgcgaacgccgacacgcugugcaucggcuaccacgccaacaacucgaccgacaccguggacaccgugcucgagaagaaggucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccaacucggacaacggcacgugcuaccccggcgacuucaucgacuacgaggagcuccgggagcagcuguccagcguguccucguucgagcgcuucgagaucuuccccaagaccuccagcuggcccaaccacgacccgaacaagggggucaccgccgccugcccccacgccggcgcgaaguccuucuacaagaaccugaucuggcucgugaagaaggggaacucguaccccaagcuguccaagucguacaucaacgacaagggcaaggaggugcugguccucugggggauccaccaccccuccaccagcgccgaccagcagucgcuguaccagaacgccgacgccuacguguucgugggcacgucccgguacucgaagaaguucaagccggagaucgccauccgccccaagguccgggaccagggcgggcgcaugaacuacuacuggacccugguggagcccggcgacaagaucaccuucgaggcgaccgggaaccucguggucccccgguacgccuucgccauggagcgcaacgccggcuccggcaucaucaucagcgacacgccggugcacgacugcaacacgaccugccagacccccaagggggccaucaacaccucccugcccuuccagaacauccaccccaucaccaucggcaagugcccgaaguacgucaagucgaccaagcugcggcucgcgaccgggcugcgcaacgugcccuccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacucgaacgugaagaaccucuacgagaagguccgcucccagcugaagaacaacgccaaggagaucggcaacgggugcuucgagcuguaccacaagugcgacaacacgugcauggagagcgugaagaacggcaccuacgacuaccccaaguacuccgaggaggccaagcucaaccgggaggagaucgacggggugaagcuggagucgacccgcaucuaccagauccuggcgaucuacuccaccgucgccucgucccucgugcugguggucagccugggcgccaucucguucuggaugugcuccaacggcagccuccagugccggaucugcaucuga

SEQ ID NO: 8158 - RNA, 1701 nt, Artificial Sequence
  derived and/or modified CDS sequence (AUadapt) from InfluenzaA__AEW25492__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacaucuucgugggcacgucgcgguacuccaagaaguucaagccggagaucgccauccgccccaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 8159 - RNA, 1701 nt, Artificial Sequence
  derived and/or modified CDS sequence (AUadapt) from InfluenzaA__AEW25501__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagaaguucgagaucuuccccaagaccucguccuggcccaaccacgacagcaacaagggggucaccgccgccugcccgcacgccggcgcgaaguccuucuacaagaaccugaucugccucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 8160 - RNA, 1701 nt, Artificial Sequence; identical to SEQ ID NO: 8148
  derived and/or modified CDS sequence (AUadapt) from InfluenzaA__AEW25509__HA

SEQ ID NO: 8161 - RNA, 1701 nt, Artificial Sequence
  derived and/or modified CDS sequence (AUadapt) from InfluenzaA__AEW25519__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacaccggcgccaagagcuucuacaagaaccugaucuggcucgugaagaaggggaacuccuaccccaagcugucgaaguccuacaucaacgacaagggcaaggaggugcugguccucugggggauccaccaccccagcacgucggcggaccagcagucccuguaccagaacgccgacgccuacguguucgugggcaccucgcgguacuccaagaaguucaagccggagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 8162 - RNA, 1701 nt, Artificial Sequence
  derived and/or modified CDS sequence (AUadapt) from InfluenzaA__AEW25528__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccucguccagcgacaacggcacgugcuaccccggcgacuucaucgacuacgaggagcugcgggagcagcucuccucgguguccagcuucgagcgcuucgagaucuuccccaagaccuccagcuggcccaaccacgacuccaacaagggggucaccgccgccugcccgcacgccggcgccaagucguucuacaagaaccugaucuggcuggugaagaaggggaacuccuaccccaagcucagcaagucguacaucaacgacaagggcaaggaggugcugguccugugggggauccaccaccccuccaccagcgcggaccagcagucccucuaccagaacgccgacgccuacguguucgugggcacgucgcgguacuccaagaaguucaagcccgagaucgccauccgcccgaagguccgggaccaggagcgccggaugaacuacuacuggacccugguggagcccggcgacaagaucaccuucgaggccaccgggaaccugguggucccccgcuacgcguucgccauggagcggaacgccggcagcgggaucaucaucuccgacacgcccgugcacgacugcaacacgaccugccagaccccgaagggcgccaucaacaccucgcuccccuuccagaacauccaccccaucaccaucggcaagugccccaaguacgugaaguccaccaagcugcgccuggccaccgggcuccggaacgucccgagcauccagucccgcggccuguucggggcgaucgccggcuucaucgagggcggguggacgggcaugguggacgggugguacggcuaccaccaccagaacgagcaggggagcggcuacgccgccgaccugaaguccacccagaacgccaucgacgagaucaccaacaaggugaacucggucaucgagaagaugaacacccaguucacggcgguggggaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgugaagaaccuguacgagaagguccggagccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcuggaguccacccggaucuaccagauccucgccaucuacagcaccgucgcgucgucccuggugcugguggucagccucggcgccaucuccuucuggaugugcagcaacgggucccugcagugccgcaucugcaucuga

SEQ ID NO: 8163 - RNA, 1701 nt, Artificial Sequence
  derived and/or modified CDS sequence (AUadapt) from InfluenzaA__AEW25545__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggucguacgacuaccccaaguacuccgaggaggccaagcugaaccgggaggagaucgacggcgugaagcucgagagcacccgcaucuaccagauccuggcgaucuacuccaccgucgccucgagccuggugaugguggucucccucggggccaucucguucuggaugugcuccaacggcagccugcagugccggaucugcaucuga

SEQ ID NO: 8164 - RNA, 1701 nt, Artificial Sequence
  derived and/or modified CDS sequence (AUadapt) from InfluenzaA__AEW25555__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacuacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 8165 - RNA, 1701 nt, Artificial Sequence
  derived and/or modified CDS sequence (AUadapt) from InfluenzaA__AEW25564__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgcccugaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccucaaccggaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcaccgggaucuaccagauccuggcgaucuacuccaccgucgccucgagccucgugcugguggucucccugggcgccaucucguucuggaugugcuccaacggcagccuccagugccggaucugcaucuga

SEQ ID NO: 8166 - RNA, 1701 nt, Artificial Sequence; identical to SEQ ID NO: 3712
  derived and/or modified CDS sequence (AUadapt) from InfluenzaA__AEW25573__HA

SEQ ID NO: 8167 - RNA, 1701 nt, Artificial Sequence
  derived and/or modified CDS sequence (AUadapt) from InfluenzaA__AEW25582__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucauccugagcgacacgcccgugcacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacggccagggguccggcuacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccucaacaagaaggucgacgacggguuccuggacaucuggaccuacaacgccgagcugcucgugcugcuggagaacgagcggacccucgacuaccacgacagcaacgugaagaaccuguacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcucaaccgggaggagaucgacggggugaagcuggagagcacccgcaucuaccagauccuggcgaucuacuccaccgucgccucgagccucgugcugguggucucccugggcgccaucucguucuggaugugcuccaacggcagccuccagugccggaucugcaucuga

SEQ ID NO: 8168 - RNA, 1701 nt, Artificial Sequence
  derived and/or modified CDS sequence (AUadapt) from InfluenzaA__AEW25590__HA
augaaggccauccuggugguccuccuguacaccuucgccaccgcgaacgccgacacgcugugcaucggcuaccacgccaacaacucgaccgacaccguggacaccgugcucgagaagaacgucacggugacccaguccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggaggcgcgcaugaacuacuacuggacccugguggagcccggcgacaagaucaccuucgaggccaccgggaaccucguggucccccgguacgccuucgccauggagcgcgacgccggcuccgggaucaucaucucggacacgcccgugcacgacugcaacacgaccugccagaccccgaagggcgcgaucaacaccucccugcccuuccagaacauccaccccaucaccaucggcaagugccccaaguacgucaagagcaccaagcugcggcucgccaccgggcugcgcaacgugccguccauccagucgcggggccuguucggggccaucgccggcuucaucgagggcggguggacgggcaugguggacgggugguacggcuaccaccaccagaacgagcagggguccggcuacgccgcggaccucaagucgacccagaacgccaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccuccacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggcgaagcugaaccgggaggagaucgacggggugaagcucgagagcacccgcaucuaccagauccuggccaucuacuccaccgucgccucgagccuggugcucguggucucccugggcgccaucucguucuggaugugcuccaacgggagccugcagugccggaucugcaucuga

SEQ ID NO: 8169 - RNA, 1701 nt, Artificial Sequence; identical to SEQ ID NO: 3712
  derived and/or modified CDS sequence (AUadapt) from InfluenzaA__AEW25600__HA

SEQ ID NO: 8170 - RNA, 1701 nt, Artificial Sequence; identical to SEQ ID NO: 3712
  derived and/or modified CDS sequence (AUadapt) from InfluenzaA__AEW25620__HA

SEQ ID NO: 8171 - RNA, 1701 nt, Artificial Sequence
  derived and/or modified CDS sequence (AUadapt) from InfluenzaA__AEW25629__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugcccccacgccgaggccaagucguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacgccuacguguucguggggacgucgcgguacuccaagaaguucaagccggagaucgccauccgccccaagguccgggaccaggagggccgcaugaacuacuacuggacccugguggagcccggcgacaagaucaccuucgaggcgaccgggaaccucguggucccccgguacgccuucgccauggagcgcaacgccggcagcgggaucaucaucuccgacacgccggugcacgacugcaacacgaccugccagacccccaagggcgccaucaacaccucgcugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacaugugcauggaguccgugaagaacggcaccuacgacuaccccaaguacagcgaggaggccaagcugaaccgggaggagaucgacggggugaagcucgaguccacgcgcaucuaccagauccuggcgaucuacucgaccgucgccuccagccuggugcucguggucucgcugggcgccaucuccuucuggaugugcagcaacgggucccugcagugccggaucugcaucuga

SEQ ID NO: 8172 - RNA, 1701 nt, Artificial Sequence; identical to SEQ ID NO: 116
  derived and/or modified CDS sequence (AUadapt) from InfluenzaA__AEW25637__HA

SEQ ID NO: 8173 - RNA, 1701 nt, Artificial Sequence
  derived and/or modified CDS sequence (AUadapt) from InfluenzaA__AEW25646__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 8174 - RNA, 1701 nt, Artificial Sequence
  derived and/or modified CDS sequence (AUadapt) from InfluenzaA__AEW25654__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccuccccgcccuuccagaacauccaccccaucaccaucgggaagugccccaaguacgucaagagcaccaagcugcggcuggcgaccggccuccgcaacauccccuccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcuggagagcacccgcaucuaccagauccucgcgaucuacuccaccguggccucgagccugguccugguggugucccucggggccaucucguucuggaugugcuccaacggcagccugcagugccggaucugcaucuga

SEQ ID NO: 8175 - RNA, 1701 nt, Artificial Sequence
  derived and/or modified CDS sequence (AUadapt) from InfluenzaA__AEW25662__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaaggggaucaccgccgccugcccccacgccggcgccaagagcuucuacaagaaccugaucuggcucgucaagaaggggaacuccuaccccaagcugucgaaguccuacaucaacgacaagggcaaggaggugcuggugcucugggggauccaccaccccagcaccucggccgaccagcagucccuguaccagaacgccgacgccuacgucuucgugggcacgucgcgguacuccaagaaguucaagccggagaucgccauccgccccaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 8176 - RNA, 1701 nt, Artificial Sequence
  derived and/or modified CDS sequence (AUadapt) from InfluenzaA__AEW25669__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggagggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 8177 - RNA, 1701 nt, Artificial Sequence
  derived and/or modified CDS sequence (AUadapt) from InfluenzaA__AEW25678__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagaaguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugcgcgccaucucguucuggaugugcuccaacgggagccugcagugccggaucugcaucuga

SEQ ID NO: 8178 - RNA, 1701 nt, Artificial Sequence
  derived and/or modified CDS sequence (AUadapt) from InfluenzaA__AEW25687__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugccccuacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 8179 - RNA, 1701 nt, Artificial Sequence; identical to SEQ ID NO: 8148
  derived and/or modified CDS sequence (AUadapt) from InfluenzaA__AEW25696__HA

SEQ ID NO: 8180 - RNA, 1701 nt, Artificial Sequence; identical to SEQ ID NO: 3712
  derived and/or modified CDS sequence (AUadapt) from InfluenzaA__AEW25706__HA

SEQ ID NO: 8181 - RNA, 1695 nt, Artificial Sequence
  derived and/or modified CDS sequence (AUadapt) from InfluenzaA__AEW91908__HA
auggagaagaucgugcugcuguucgccaccaucucgcuggucaaguccgaccacaucugcaucggcuaccacgccaacaacucgaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgaugugcgacgaguucaucaacguccccgaguggagcuacaucguggagaaggccaaccccgccaacgaccucugcuaccccgggaacuucaacgacuacgaggagcugaagcaccuccucucccgcaucaaccacuucgagaagauccagaucaucccgaagaacucgugguccgaccacgaggccagccugggcguguccgcggccugccccuaccagggcaagucguccuucuuccggaacgucguguggcugaucaagaaggacaacgccuaccccacgaucaagaagggguacaacaacaccaaccaggaggaccuccuggugcuguggggcauccaccaccccaacgacgaggccgagcagacccgccucuaccagaacccgaccacguacaucagcaucgggaccuccacccugaaccagcggcugguccccaagaucgcgacccgcucgaagaucaacggccaguccgggcggaucgacuucuucuggacgauccucaagcccaacgacgccauccacuucgagagcaacggcaacuucaucgcccccgaguacgccuacaagaucgugaagaagggcgacuccaccaucaugaaguccgagguggaguacgggaacugcaacacccgcugccagaccccgaucggcgccaucaacucgucgaugcccuuccacaacauccacccccugacgaucggggagugccccaaguacgucaagagcaacaagcuggugcucgcgaccggccugcggaacuccccgcagggcgagacccgcgggcuguucggcgccaucgccggguucaucgagggcggguggcagggcaugguggacggcugguacggguaccaccacucgaacgagcagggcuccggguacgccgccgacaaggagagcacccagaaggcgaucgacggcgucacgaacaaggugaacuccaucaucgacaagaugaacacccaguucgaggccguggggcgggaguucaacaaccucgagcgccggaucgagaaccugaacaagaagauggaggacggcuuccuggacgucuggaccuacaacgccgagcuccuggugcugauggagaacgagcgcacccucgacuuccacgacucgaacgugcggaaccuguacgacaagguccgccugcagcucaaggacaacgccaaggagcugggcaacgggugcuucgaguucuaccacaagugcgacaacgagugcauggaguccgugcggaacggcacguacgacuacccccaguacagcgaggaggcccgccugaagcgggaggagaucuccggggucaagcucgagucgaucggcaucuaccagauccuguccaucuacagcaccguggcguccucgcuggugcucgccaucaugauggccgggcugucccuguggaugugcagcaacggcucccuccagugccgcaucugcaucuga

SEQ ID NO: 8182 - RNA, 1701 nt, Artificial Sequence
  derived and/or modified CDS sequence (AUadapt) from InfluenzaA__AEX09175__HA
augaaggccauccuggugguccuccuguacaccuucgccaccgcgaacgccgacacgcugugcaucggcuaccacgccaacaacucgaccgacaccguggacaccgugcucgagaagaacgucgccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggaccgcgagggccggaugaacuacuacuggacgcugguggagcccggggacaagaucaccuucgaggccaccggcaaccucguggucccccgcuacgccuucgccauggagcggaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcgccucgccaccggccugcggaacgugccguccauccagagccgcgggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgcgaggagaucgacggcgugaagcucgagagcacccggaucuaccagauccuggccaucuacuccaccgucgccucgagccuggugcucguggucucccugggggccaucucguucuggaugugcuccaacggcagccugcagugccgcaucugcaucuga

SEQ ID NO: 8183 - RNA, 1701 nt, Artificial Sequence; identical to SEQ ID NO: 116
  derived and/or modified CDS sequence (AUadapt) from InfluenzaA__AEX25795__HA

SEQ ID NO: 8184 - RNA, 1701 nt, Artificial Sequence
  derived and/or modified CDS sequence (AUadapt) from InfluenzaA__AEX25797__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccacaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 8185 - RNA, 1701 nt, Artificial Sequence
  derived and/or modified CDS sequence (AUadapt) from InfluenzaA__AEX25798__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 8186 - RNA, 1701 nt, Artificial Sequence; identical to SEQ ID NO: 116
  derived and/or modified CDS sequence (AUadapt) from InfluenzaA__AEX25800__HA

SEQ ID NO: 8187 - RNA, 1701 nt, Artificial Sequence; identical to SEQ ID NO: 116
  derived and/or modified CDS sequence (AUadapt) from InfluenzaA__AEX25803__HA

SEQ ID NO: 8188 - RNA, 1701 nt, Artificial Sequence; identical to SEQ ID NO: 3156
  derived and/or modified CDS sequence (AUadapt) from InfluenzaA__AEX25808__HA

SEQ ID NO: 8189 - RNA, 1701 nt, Artificial Sequence; identical to SEQ ID NO: 5884
  derived and/or modified CDS sequence (AUadapt) from InfluenzaA__AEX25810__HA

SEQ ID NO: 8190 - RNA, 1701 nt, Artificial Sequence
  derived and/or modified CDS sequence (AUadapt) from InfluenzaA__AEX25811__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguucaccgcguccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaaggccggguccggcaucaucaucagcgacacccccgugcacgacugcaacacgaccugccagaccccgaagggcgccaucaacaccucccugcccuuccacaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 8191 - RNA, 1701 nt, Artificial Sequence; identical to SEQ ID NO: 5884
  derived and/or modified CDS sequence (AUadapt) from InfluenzaA__AEX25814__HA

SEQ ID NO: 8192 - RNA, 1701 nt, Artificial Sequence
  derived and/or modified CDS sequence (AUadapt) from InfluenzaA__AEX25816__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgaacagcugguccuacaucguggagaccucguccagcgacaacggcacgugcuaccccggcgacuucaucaacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 8193 - RNA, 1701 nt, Artificial Sequence
  derived and/or modified CDS sequence (AUadapt) from InfluenzaA__AEX25818__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccagagcaccucggccgaccagcagucccuguaccagaacgccgacgccuacguguucgugggcagcucccgguacucgaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccggguccggcaucaucaucagcgacacccccgugcacgacugcaacacgaccugccagacccccaagggcgccaucaacaccucccugccguuccacaacauccaccccaucacgaucgggaagugccccaaguacgucaagucgaccaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 8194 - RNA, 1701 nt, Artificial Sequence
  derived and/or modified CDS sequence (AUadapt) from InfluenzaA__AEX25824__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacguggagucgaccaagcugcggcucgcgaccggccugcgcaacgucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 8195 - RNA, 1698 nt, Artificial Sequence
  derived and/or modified CDS sequence (AUadapt) from InfluenzaA__AEX33420__HA
augaaggugaagcugcucguccugcugugcaucuucaccgccaccuacgccgacacgaucugcaucggcuaccacgcgaacaacucgaccgacaccguggacaccgugcucgagaagaacgucacggugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacgggaccugcuaccccggcuacuucgccgacuacgaggagcugcgcgagcagcucuccagcguguccucguucgagcgguucgagaucuucccgaaggaguccagcuggcccaaccacacggucaccgggguguccgccagcugcucccacaacggcaagagcuccuucuaccgcaaccugcuguggcucaccggcaagagcggccuguaccccaaccuguccaagucguacgccaacaacaaggagaaggaggugcucguccuguggggcgugcaccacccgcccaacaucggggaccagcgggcccuguaccacaccgagaacgccuacgugagcgucguguccagccacuacucccgccgguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucagccgcggguucggcuccggcaucaucaccagcaacgcccccauggacgagugcgacgcgaagugccagacgccccagggggccaucaacuccucgcugcccuuccagaacguccacccggugaccaucggcgagugccccaaguacgugaaguccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacucggaggaguccaagcucaaccgggagaagaucgacggcgugaagcuggagagcaugggcgucuaccagauccuggccaucuacagcaccguggccuccagccucgugcugcuggucucccucggggccaucagcuucuggaugugcuccaacggcagccugcagugccgcaucugcaucuga

SEQ ID NO: 8196 - RNA, 1701 nt, Artificial Sequence
  derived and/or modified CDS sequence (AUadapt) from InfluenzaA__AEX33453__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccgacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 8197 - RNA, 1701 nt, Artificial Sequence; identical to SEQ ID NO: 2040
  derived and/or modified CDS sequence (AUadapt) from InfluenzaA__AEX33464__HA

SEQ ID NO: 8198 - RNA, 1701 nt, Artificial Sequence; identical to SEQ ID NO: 2040
  derived and/or modified CDS sequence (AUadapt) from InfluenzaA__AEX33475__HA

SEQ ID NO: 8199 - RNA, 1701 nt, Artificial Sequence; identical to SEQ ID NO: 2040
  derived and/or modified CDS sequence (AUadapt) from InfluenzaA__AEX33486__HA

SEQ ID NO: 8200 - RNA, 1701 nt, Artificial Sequence; identical to SEQ ID NO: 2040
  derived and/or modified CDS sequence (AUadapt) from InfluenzaA__AEX33497__HA

SEQ ID NO: 8201 - RNA, 1701 nt, Artificial Sequence; identical to SEQ ID NO: 2040
  derived and/or modified CDS sequence (AUadapt) from InfluenzaA__AEX33508__HA

SEQ ID NO: 8202 - RNA, 1701 nt, Artificial Sequence; identical to SEQ ID NO: 2040
  derived and/or modified CDS sequence (AUadapt) from InfluenzaA__AEX33519__HA

SEQ ID NO: 8203 - RNA, 1701 nt, Artificial Sequence
  derived and/or modified CDS sequence (AUadapt) from InfluenzaA__AEX33541__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccagcugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcccaggcgagcggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagucgacccaggccgcgaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 8204 - RNA, 1701 nt, Artificial Sequence
  derived and/or modified CDS sequence (AUadapt) from InfluenzaA__AEX33574__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgacugcaucggcucgauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 8205 - RNA, 1701 nt, Artificial Sequence; identical to SEQ ID NO: 2040
  derived and/or modified CDS sequence (AUadapt) from InfluenzaA__AEX33585__HA

SEQ ID NO: 8206 - RNA, 1701 nt, Artificial Sequence
  derived and/or modified CDS sequence (AUadapt) from InfluenzaA__AEX33596__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 8207 - RNA, 1701 nt, Artificial Sequence; identical to SEQ ID NO: 2040
  derived and/or modified CDS sequence (AUadapt) from InfluenzaA__AEX33618__HA

SEQ ID NO: 8208 - RNA, 1701 nt, Artificial Sequence; identical to SEQ ID NO: 2040
  derived and/or modified CDS sequence (AUadapt) from InfluenzaA__AEX33629__HA

SEQ ID NO: 8209 - RNA, 1701 nt, Artificial Sequence; identical to SEQ ID NO: 8206
  derived and/or modified CDS sequence (AUadapt) from InfluenzaA__AEX33640__HA

SEQ ID NO: 8210 - RNA, 1701 nt, Artificial Sequence
  derived and/or modified CDS sequence (AUadapt) from InfluenzaA__AEX33836__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacaucuuccugaucaacuccaccggcaaccucaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccucaaguccacccaggcggccaucaaccagaucaacggcaagcugaaccggcugaucggcaagaccaacgagaaguuccaccagaucgagaaggaguucucggaggucgaggggcgcauccaggaccucgagaaguacguggaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagucgggcuacaaggacuggauccuguggaucuccuucgccaucagcugcuuccugcucugcguggcccugcugggguucaucaugugggccugccagaagggcaacauccggugcaacaucugcaucuga

SEQ ID NO: 8211 - RNA, 1701 nt, Artificial Sequence; identical to SEQ ID NO: 875
  derived and/or modified CDS sequence (AUadapt) from InfluenzaA__AEX33880__HA

SEQ ID NO: 8212 - RNA, 1698 nt, Artificial Sequence
  derived and/or modified CDS sequence (AUadapt) from InfluenzaA__AEX33913__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggagaacuccuggcccaaccacacgaccaccggggucucggccuccugcagccacaacggcgaguccagcuucuacaagaaccugcuguggcucaccgggaagaacggccuguaccccaaccuguccaagucguacgccaacaacaagaagaaggaggugcucgugcuguggggcguccaccacccgcccaacaucggcaaccagcgggcccuguaccacacggagaacgccuacguguccguggucagcagccacuacucccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucgcggggguucggcuccggcaucaucaacagcaacgcccccauggacgagugcgacgcgaagugccagacgccccagggggccaucaacuccagccugcccuuccagaacgugcacccggucaccaucggcgagugccccaaguacgugcgcuccgccaagcugcggauggugaccgggcuccgcaacauccccucgauccagucccggggccuguucggggccaucgccggcuucaucgagggcggguggaccggcauggucgacgggugguacggcuaccaccaccagaacgagcaggggagcggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacuccaacgugaagaaccucuacgagaaggucaagucgcagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaaguucgagagcaugggcguguaccagauccucgccaucuacuccaccgucgccucgagccuggugcugcucgugucccugggggccaucagcuucuggaugugcuccaacggcagccugcagugccgcaucugcaucuga

SEQ ID NO: 8213 - RNA, 1698 nt, Artificial Sequence
  derived and/or modified CDS sequence (AUadapt) from InfluenzaA__AEX33924__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagucgugguccuacaucguggagaagcccagccccgagaacgggaccugcuaccccggccacuucgccgacuacgaggagcugcgggagcagcuguccagcguguccucguucgagcgcuucgagaucuucccgaaggaguccagcuggcccaaccacacggccaccggggucuccgccagcugcucccacaacggcaagucguccuucuacaagaaccuccuguggcugaccgggaagaacggccucuaccccaaccugagcaagagcuacgccaacaacaaggagaaggaggugcuggugcucuggggcguccaccacccgcccaacaucggcgaccagcgggcccuguaccacaccgagaacgccuacguguccguggucagcucccacuacucgcgcaaguucacgcccgagaucgcgaagcggcccaaggugcgcgaccagaagggccggaucaacuacuacuggacccugcucgagcccggggacaccaucaucuucgaggccaacggcaaccugaucgccccgcgcuacgccuucgcccugucccggggguucggcagcggcaucaucaacuccaacgcgcccauggacgagugcgacgccaagugccagacgccccagggggccaucaacagcucccuccccuuccagaacgugcacccggucaccaucggcgagugccccaaguacgugcgcucggccaagcugcggauggugaccgggcugcgcaacauccccuccauccagagccggggccucuucggggccaucgcgggcuucaucgagggcggguggaccggcauggucgacgggugguacggcuaccaccaccagaacgagcagggguccggcuacgccgccgaccagaaguccacccagaacgccaucaacggcaucacgaacaaggugaacagcgugaucgagaagaugaacacccaguucaccgccgucgggaaggaguucaacaagcuggagcgccggauggagaaccugaacaagaagguggacgacggcuucaucgacaucuggaccuacaacgcggagcuccugguccugcucgagaacgagcgcacgcuggacuuccacgacucgaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcuggagucgaugggcguguaccagauccucgccaucuacuccaccgucgccagcucccuggugcugcucgugagccugggggccaucuccuucuggaugugcagcaacggcucccugcagugccgcaucugcaucuga

SEQ ID NO: 8214 - RNA, 1701 nt, Artificial Sequence
  derived and/or modified CDS sequence (AUadapt) from InfluenzaA__AEX33957__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagguggaggucacgaacgccaccgagcuggugcagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgucccggacuacgcgucccugcggagccucguggccuccucggggacgcuggaguucaacaacgaguccuucaacuggaccggcgugacccagaacgggaccagcuccgccugcaagcgcggcucgaacaacuccuucuucucgcggcugaacuggcucacgcacuccaaguucaaguaccccgcccugaacgucaccaugcccaacaacgaggaguucgacaagcuguacaucuggggcgugcaccaccccgggaccgacaacgaccagaucuuccucuacgcgcaggccagcggccgcaucaccguguccacgaagcggucgcagcagaccgucaucccgaacaucgggagccgcccccgggugcgcaacauccccucccggaucucgaucuacuggaccaucgugaagcccggcgacauccugcugaucaacuccaccgggaaccucaucgccccgcgcggcuacuucaagauccggagcggcaaguccucgaucaugcgcuccgacgcccccaucgggaagugcaacucggagugcaucacgcccaacggcuccauccccaacgacaagccguuccagaacgucaaccggaucaccuacggggccugcccccgcuacgugaagcagaacacccugaagcuggcgaccggcaugcggaacgugcccgagaagcagacgcgcgggaucuucggcgccaucgccggcuucaucgagaacgggugggagggcauggucgacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucucggagguggagggccggauccaggaccucgagaaguacguggaggacaccaagaucgaccugugguccuacaacgccgagcugcucgucgcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgcuuccagaucaagggcguggagcucaagucgggguacaaggacuggauccuguggaucuccuucgccaucagcugcuuccugcucugcgucgcccugcugggcuucaucaugugggccugccagaaggggaacauccggugcaacaucugcaucuga

SEQ ID NO: 8215 - RNA, 1701 nt, Artificial Sequence
  derived and/or modified CDS sequence (AUadapt) from InfluenzaA__AEX33968__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucaacuggaccggcgugacccagaacgggaccucguccgccugcaagcgcggcagcaacaacuccuucuucucgcggcugaacuggcucacgcacuccaaguucaaguaccccgcccugaacgugaccaugcccaacaacgaggaguucgacaagcuguacaucuggggcguccaccaccccgggaccgacaacgaccagaucuuccuccacgcgcaggccucgggccgcaucaccguguccacgaagcggagccagcagaccgugaucccgaacaucgggucgcgcccccggguccgcaacauccccucccggaucucgaucuacuggaccaucgugaagcccggcgacauccugcugaucaacuccaccgggaaccucaucgccccgcgcggcuacuucaagauccggagcggcaaguccucgaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacucggaggggaucggccaggccgccgaccucaaguccacccaggcggccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagucgggguacaaggacuggauccuguggaucuccuucgccaucagcugcuuccugcucugcguggcccugcugggcuucaucaugugggccugccagaaggggaacauccggugcaacaucugcaucuga

SEQ ID NO: 8216 - RNA, 1701 nt, Artificial Sequence
  derived and/or modified CDS sequence (AUadapt) from InfluenzaA__AEX33979__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaacgggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8217 - RNA, 1701 nt, Artificial Sequence
  derived and/or modified CDS sequence (AUadapt) from InfluenzaA__AEX33990__HA
augaagaccaucaucgcccugucguacauccucuaccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccagagcgggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcaggacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaagagcguggagcugaaguccggguacaaggacuggauccuguggaucagcuucgccaucuccugcuuccuccugugcguggcccugcucggcuucaucaugugggccugccagaagggcaacauccggugcaacaucugcaucuga

SEQ ID NO: 8218 - RNA, 1701 nt, Artificial Sequence
  derived and/or modified CDS sequence (AUadapt) from InfluenzaA__AEX34001__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacucggaguccuucaacuggaccggcgugacccagaacgggaccucguccgccugcaagcgccggagcaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugagcacgaagcgcucgcagcagaccgugaucccgaacaucggcucccggccccgcguccggaacauccccagccgcaucuccaucuacuggaccaucgugaagcccggggacauccugcucaucaacucgaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacgccgagggcaucgggcaggccgcggaccugaaguccacccaggccgccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggcgugccagaagggcaacauccggugcaacaucugcaucuga

SEQ ID NO: 8219 - RNA, 1701 nt, Artificial Sequence
  derived and/or modified CDS sequence (AUadapt) from InfluenzaA__AEX34012__HA
augaagaccaucaucgcccugucguacauccucuaccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccagagcgggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 8220 - RNA, 1701 nt, Artificial Sequence; identical to SEQ ID NO: 2679
  derived and/or modified CDS sequence (AUadapt) from InfluenzaA__AEX34023__HA

SEQ ID NO: 8221 - RNA, 1701 nt, Artificial Sequence
  derived and/or modified CDS sequence (AUadapt) from InfluenzaA__AEX34044__HA
augaagaccaucaucgccuucucguacauccugugccucguguucgcccagaagcugcccggcaucgacaacuccaccgcgacgcugugccucgggcaccacgccgucccgaacggcaccaucgugaagaccaucaccaacgaccagaucgaggugacgaacgccaccgagcugguccagagcuccucgaccgggggcaucugcgacagcccccaccagauccuggacggggagaacugcacccucaucgacgcccugcugggcgacccccagugcgacggcuuccagaacaagaagugggaccucuucguggagcgcucgaaggccuacuccaacugcuaccccuacgacgugccggacuacgcgagccugcggucccuggucgccucguccgggacgcucgaguucaacaacgagagcuucaacuggaccggcgugacccagaacgggaccuccucggccugcaagcgcggcuccaacaacagcuucuucucccggcugaacuggcugacgcacucgaaguucaaguaccccgcccucaacgugaccaugcccaacaacgaggaguucgacaagcuguacaucuggggcguccaccaccccgggaccgacaacgaccagaucuuccuguacgcgcaggccuccggccgcaucaccgugagcacgaagcggucgcagcagaccgugaucccgaacaucgggucccgcccccggguccgcaacauccccagccggaucuccaucuacuggaccaucgugaagcccggcgacauccuccugaucaacucgaccgggaaccugaucgccccgcgcggcuacuucaagauccgguccggcaagagcuccaucaugcgcucggacgcccccaucgggaagugcaacuccgagugcaucacgcccaacggcagcauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccugaaguccacccaggcggccaucgaccagaucaacggcaagcucaaccgccugaucgggaagaccaacgagaaguuccaccagaucgagaaggaguucuccgaggucgagggccggauccaggaccuggagaaguacguggaggacaccaagaucgaccucuggucguacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgcuuccagaucaagggcguggagcugaaguccggguacaaggacuggauccucuggaucagcuucgccaucuccugcuuccugcugugcguggcccuccugggcuucaucaugugggccugccagaaggggaacauccggugcaacaucugcaucuga

SEQ ID NO: 8222 - RNA, 1701 nt, Artificial Sequence
  derived and/or modified CDS sequence (AUadapt) from InfluenzaA__AEX34089__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucguccaacagcuucuucucccggcugaacuggcucacgcacucgaaguucaaguaccccgcccugaacgugaccaugcccaacaacgaggaguucgacaagcuguacaucuggggcguccaccaccccgggaccgacaacgaccagaucuuccucuacgcgcaggccuccggccgcaucaccgugagcacgaagcggucgcagcagaccgugaucccgaacaucgggucccgcccccggguccgcaacauccccagccggaucuccaucuacuggaccaucgugaagcccggcgacauccugcugaucaacucgaccgggaaccucaucgccccgcgcggcuacuucaagauccgguccggcaagagcuccaucaugcgcucggacgcccccaucgggaagugcaacuccgagugcaucacgcccaacggcagcauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagucgacccaggcggccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccggugcaacaucugcaucuga

SEQ ID NO: 8223 - RNA, 1701 nt, Artificial Sequence
  derived and/or modified CDS sequence (AUadapt) from InfluenzaA__AEX34123__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucgaacaacuccuucuucucgcggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagcggucgcagcagaccgugaucccgaacaucgggagccgcccccggguccgcaacauccccucccggaucucgaucuacuggaccaucgugaagcccggcgacauccugcugaucaacuccaccgggaaccucaucgccccgcgcggcuacuucaagauccggagcggcaaguccucgaucaugcgcuccgacgcccccaucgggaagugcaacucggagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagucgggguacaaggacuggauccuguggaucuccuucgccaucagcugcuuccugcucugcguggcccugcugggcuucaucaugugggccugccagaaggggaacauccggugcaacaucugcaucuga

SEQ ID NO: 8224 - RNA, 1701 nt, Artificial Sequence
  derived and/or modified CDS sequence (AUadapt) from InfluenzaA__AEX34134__HA
augaagaccaucaucgcccugucguacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggacgggggugacccagaacggcaccuccucggccugcauccgccgguccaacaacagcuucuucucccgccugaacuggcucacccaccugaaguucaaguaccccgcccugaacgugacgaugcccaacaacgagaaguucgacaagcucuacaucuggggcguccaccaccccgggaccgacaacgaccagaucuuccuguacgcgcaggccucggggcggaucaccguguccaccaagcgcagccagcagacggugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacagcgaggggaucggccaggccgccgaccugaaguccacgcaggcggccaucgaccagaucaacgggaagcugaaccggcucaucggcaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8225 - RNA, 1701 nt, Artificial Sequence; identical to SEQ ID NO: 8223
  derived and/or modified CDS sequence (AUadapt) from InfluenzaA__AEX34145__HA

SEQ ID NO: 8226 - RNA, 1701 nt, Artificial Sequence
  derived and/or modified CDS sequence (AUadapt) from InfluenzaA__AEX34156__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcggcucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaccgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggacguacgaccacgacgucuaccgcgacgaggcccucaacaaccgguuccagaucaagggcguggagcugaaguccggcuacaaggacuggauccuguggaucuccuucgccaucagcugcuuccuccugugcgugguccugcucggguucaucaugugggccugccagaagggcaacauccgcugcaacaucugcaucuga

SEQ ID NO: 8227 - RNA, 1701 nt, Artificial Sequence; identical to SEQ ID NO: 2173
  derived and/or modified CDS sequence (AUadapt) from InfluenzaA__AEX34178__HA

SEQ ID NO: 8228 - RNA, 1701 nt, Artificial Sequence
  derived and/or modified CDS sequence (AUadapt) from InfluenzaA__AEX34188__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcuccaaggccuacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccaacaacucguucuucucccgccugaacuggcugacgcaccucaaguucaaguaccccgcccugaacgugaccaugcccaacaacgagaacuucgacaagcuguacaucuggggcguccaccaccccgggaccgacaacgaccagaucuuccucuacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcugaucaacuccaccgggaaccucaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccucaaguccacccaggcggccaucgaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacucggagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcaucgcccugcugggcuucaucaugugggccugccagaaggggaacauccgcugcaacaucugcaucuga

SEQ ID NO: 8229 - RNA, 1701 nt, Artificial Sequence; identical to SEQ ID NO: 2679
  derived and/or modified CDS sequence (AUadapt) from InfluenzaA__AEX34199__HA

SEQ ID NO: 8230 - RNA, 1701 nt, Artificial Sequence
  derived and/or modified CDS sequence (AUadapt) from InfluenzaA__AEX34221__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgcggcuccaacaacagcuucuucucccggcugaacuggcucacgcacucgaaguucaaguaccccgcccugaacgugaccaugcccaacaacgaggaguucgacaagcuguacaucuggggcguccaccaccccgggaccgacaacgaccagaucuuccucuacgcgcaggccuccggccgcaucaccgugagcacgaagcggucgcagcagaccgugaucccgaacaucgggucccgcccccggguccgcaacauccccagccggaucuccaucuacuggaccaucgugaagcccggcgacauccugcugaucaacucgaccgggaaccucaucgccccgcgcggcuacuucaagauccgguccggcaagagcuccaucaugcgcucggacgcccccaucgggaagugcgacuccgagugcaucacgcccaacggcagcauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagucgacccaggcggccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccggugcaacaucugcaucuga

SEQ ID NO: 8231 - RNA, 1701 nt, Artificial Sequence; identical to SEQ ID NO: 2173
  derived and/or modified CDS sequence (AUadapt) from InfluenzaA__AEX34243__HA

SEQ ID NO: 8232 - RNA, 1701 nt, Artificial Sequence; identical to SEQ ID NO: 8228
  derived and/or modified CDS sequence (AUadapt) from InfluenzaA__AEX34254__HA

SEQ ID NO: 8233 - RNA, 1701 nt, Artificial Sequence; identical to SEQ ID NO: 2173
  derived and/or modified CDS sequence (AUadapt) from InfluenzaA__AEX34265__HA

SEQ ID NO: 8234 - RNA, 1701 nt, Artificial Sequence
  derived and/or modified CDS sequence (AUadapt) from InfluenzaA__AEX34275__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggucgcucgucgccuccagcgggacgcuggaguucaacaacgaguccuucaacuggaccggcgugacccagaacgggaccucguccgccugcaagcgcggcagcaacaacuccuucuucucgcggcugaacuggcucacgcacuccaaguucaaguaccccgcccugaacgugaccaugcccaacaacgaggaguucgacaagcuguacaucuggggcguccuccaccccgggaccgacaacgaccagaucuuccuguacgcgcaggccagcggccgcaucaccguguccacgaagcggucgcagcagaccgugaucccgaacaucgggagccgcccccggguccgcaacauccccucccggaucucgaucuacuggaccaucgugaagcccggcgacauccugcucaucaacuccaccgggaaccugaucgccccgcgcggcuacuucaagauccggagcggcaaguccucgaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacucggaggggaucggccaggccgccgaccugaaguccacccaggcggccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacuacgucuaccgcgacgaggcccucaacaaccgcuuccagaucaagggcguggagcucaagagcggguacaaggacuggauccuguggaucuccuucgccaucagcugcuuccugcugugcguggcccugcucggcuucaucaugugggccugccagaaggggaacauccggugcaacaucugcaucuga

SEQ ID NO: 8235 - RNA, 1698 nt, Artificial Sequence; identical to SEQ ID NO: 2733
  derived and/or modified CDS sequence (AUadapt) from InfluenzaA__AEX34318__HA

SEQ ID NO: 8236 - RNA, 1698 nt, Artificial Sequence
  derived and/or modified CDS sequence (AUadapt) from InfluenzaA__AEX34329__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccuggugagcaaggaguccuggucguacaucguggagaagcccaaccccgagaacgggaccugcuaccccggccacuucgccgacuacgaggagcugcgcgagcagcucuccagcgucuccagcuucgagcgguucgagaucuucccgaaggaguccagcuggcccaaccacacggugaccgggguguccgccucgugcucccacaacggcgagagcuccuucuaccgcaaccugcuguggcucaccgggaagaacggccuguaccccaaccugagcaaguccuacgccaacaacaaggagaaggagguccucgugcuguggggcgugcaccacccgcccaacaucggcgaccagaaggcccuguaccacaccgagaacgccuacgucucgguggugagcucccacuacagccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacucggugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgagggcgucaagcucgaguccaugggcguguaccagauccuggccaucuacucgaccguggccagcucccugguccuccuggugagccugggggccaucuccuucuggaugugcagcaacggcucccuccagugccggaucugcaucuga

SEQ ID NO: 8237 - RNA, 1701 nt, Artificial Sequence
  derived and/or modified CDS sequence (AUadapt) from InfluenzaA__AEX34352__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccugaacgacaagcccuuccagaacgugaaccgcaucaccuacggggccugcccgcgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcucaaccggcugaucggcaagaccaacgagaaguuccaccagaucgagaaggaguucucggaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 8238 - RNA, 1701 nt, Artificial Sequence; identical to SEQ ID NO: 2679
  derived and/or modified CDS sequence (AUadapt) from InfluenzaA__AEX34364__HA

SEQ ID NO: 8239 - RNA, 1701 nt, Artificial Sequence; identical to SEQ ID NO: 2679
  derived and/or modified CDS sequence (AUadapt) from InfluenzaA__AEX34375__HA

SEQ ID NO: 8240 - RNA, 1701 nt, Artificial Sequence
  derived and/or modified CDS sequence (AUadapt) from InfluenzaA__AEX34386__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgucgcugcggucccucguggccagcuccggcacgcuggaguucaacaacgagucguucaacuggaccggggucacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccucggggcggaucaccgucuccacgaagcgcagccagcagaccgugaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 8241 - RNA, 1701 nt, Artificial Sequence
  derived and/or modified CDS sequence (AUadapt) from InfluenzaA__AEX34407__HA
augaagaccaucaucgcccugucguacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggacgggggugacccagaacggcaccuccucggccugcauccgccgguccaacaacagcuucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccucggggcggaucaccguguccaccaagcgcagccagcagacggugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccugucggggaaguccagcaucaugcgcuccgacgcccccaucggcaagugcaacucggagugcaucacccccaacggcuccauccccaacgacaagccguuccagaacgugaaccggaucacguacggggccugcccccgcuacgucaagcagaacacccucaagcuggcgaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcucaaccggcugaucggcaagaccaacgagaaguuccaccagaucgagaaggaguucucggaggucgagggccgcauccaggaccuggagaaguacguggaggacaccaagguggaccucugguccuacaacgccgagcugcuggucgcccucgagaaccagcacaccaucgaccugacggacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaaggggguggagcugaaguccggcuacaaggacuggauccucuggaucuccuucgccaucagcugcuuccugcugugcgucgcccuccugggcuucaucaugugggccugccagaaggggaacauccgcugcaacaucugcaucuga

SEQ ID NO: 8242 - RNA, 1698 nt, Artificial Sequence
  derived and/or modified CDS sequence (AUadapt) from InfluenzaA__AEX34440__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaccucgcgcgaguccuggagcuacaucguggagaagcccaaccccgagaacggcacgugcuaccccggccacuucgccgacuacgaggagcugcgggagcagcucuccagcguguccucguucgagcgcuucgagaucuucccgaaggaguccagcuggcccaaccacaccaccaccggggucuccgccagcugcucccacaacggcgagucguccuucuacaagaaccugcuguggcucacggggaagaacggccuguaccccaaccugagcaaguccuacgccaacaacaaggagaaggaggugcucgugcuguggggcguccaccacccgcccaacaucgggaaccagcgggcccuguaccacaccgagaacgccuacgugagcguggucucgucccacuacagccgcaaguucacccccgagaucgccaagcggcccaaggugcgcgaccaggagggccggaucaacuacuacuggacccuccuggagcccggggacacgaucaucuucgaggcgaacggcaaccugaucgccccgcgcuacgccuucgcccucucccggggguucggcucgggcaucaucaacuccaacgcccccauggacgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagucgcggggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcgccggauggagaaccucaacaagaagguggacgacggcuucaucgacaucuggaccuacaacgccgagcugcugguccuccuggagaacgagcgcacccuggacuuccacgacagcaacgugaagaaccucuacgagaaggugaagucccagcugaagaacaacgcgaaggagaucgggaacggcugcuucgaguucuaccacaagugcaacgacgagugcauggagucggucaagaacgggaccuacgacuaccccaaguacuccgaggagagcaagcugaaccgggagaagaucgacggcgugaagcucgaguccaugggcguguaccagauccuggccaucuacagcacggucgccucgucccuggugcuccuggugagccugggggccaucuccuucuggaugugcagcaacggcucccuccagugccgcaucugcaucuga

SEQ ID NO: 8243 - RNA, 1698 nt, Artificial Sequence; identical to SEQ ID NO: 544
  derived and/or modified CDS sequence (AUadapt) from InfluenzaA__AEX34462__HA

SEQ ID NO: 8244 - RNA, 1698 nt, Artificial Sequence
  derived and/or modified CDS sequence (AUadapt) from InfluenzaA__AEX34473__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccggcaagagcgggcuguaccccaaccuguccaagucguacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucagccgcggguucggcuccggcaucaucacgagcaacgcccccauggacgagugcgacgcgaagugccagacgccccagggggccaucaacuccucgcugcccuuccagaacguccacccggugaccaucggcgagugccccaaguacgugaaguccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagagcgccaucaacggcaucaccaacaaggugaacuccgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagucggugaagaacgggaccuacgacuaccccaaguacuccgaggagagcaagcucaaccgggagaagaucgacggcgugaagcuggagagcaugggcgucuaccagauccuggccaucuacuccacgguggccagcucccucgugcugcuggucagccucggggccaucuccuucuggaugugcagcaacggcucccugcagugccgcaucugcaucuga

SEQ ID NO: 8245 - RNA, 1698 nt, Artificial Sequence
  derived and/or modified CDS sequence (AUadapt) from InfluenzaA__AEX34495__HA
augaaggugaagcugcucguccugcugugcaucuucaccgccaccuacgccgacacgaucugcaucggcuaccacgcgaacaacucgaccgacaccguggacaccgugcucgagaagaacgucacggugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacgggaccugcuaccccggcuacuucgccgacuacgaggagcugcgcgagcagcucuccagcguguccagcuucgagcgguucgagaucuucccgaaggaguccucguggcccaaccacacggucaccgggguguccgccagcugcucccacaacggcaagagcuccuucuaccgcaaccugcuguggcucaccggcaagagcggccuguaccccaaccuguccaagagcuacgccaacaacaaggagaaggaggugcucguccuguggggcgugcaccacccgcccaacaucggggugcagcgggcccuguaccacaccgagaacgccuacgucagcgugguguccagccacuacucccgccgguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucgcgcggguucggcuccggcaucaucaccagcaacgcccccauggacgagugcgacgcgaagugccagacgccccagggggccaucaacuccagccugcccuuccagaacgugcacccggugaccaucggcgagugccccaaguacgucaaguccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuuccuggacaucuggacguacaacgccgagcugcucgugcugcuggagaacgagcgcacccucgacuuccacgacuccaacgucaagaaccuguacgagaaggucaagucgcagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 8246 - RNA, 1698 nt, Artificial Sequence; identical to SEQ ID NO: 8245
  derived and/or modified CDS sequence (AUadapt) from InfluenzaA__AEX34506__HA

SEQ ID NO: 8247 - RNA, 1698 nt, Artificial Sequence; identical to SEQ ID NO: 8245
  derived and/or modified CDS sequence (AUadapt) from InfluenzaA__AEX34517__HA

SEQ ID NO: 8248 - RNA, 1698 nt, Artificial Sequence; identical to SEQ ID NO: 8245
  derived and/or modified CDS sequence (AUadapt) from InfluenzaA__AEX34528__HA

SEQ ID NO: 8249 - RNA, 1698 nt, Artificial Sequence; identical to SEQ ID NO: 8245
  derived and/or modified CDS sequence (AUadapt) from InfluenzaA__AEX34539__HA

SEQ ID NO: 8250 - RNA, 1698 nt, Artificial Sequence; identical to SEQ ID NO: 8245
  derived and/or modified CDS sequence (AUadapt) from InfluenzaA__AEX34550__HA

SEQ ID NO: 8251 - RNA, 1698 nt, Artificial Sequence; identical to SEQ ID NO: 8245
  derived and/or modified CDS sequence (AUadapt) from InfluenzaA__AEX34561__HA

SEQ ID NO: 8252 - RNA, 1698 nt, Artificial Sequence; identical to SEQ ID NO: 8245
  derived and/or modified CDS sequence (AUadapt) from InfluenzaA__AEX34572__HA

SEQ ID NO: 8253 - RNA, 1698 nt, Artificial Sequence; identical to SEQ ID NO: 8245
  derived and/or modified CDS sequence (AUadapt) from InfluenzaA__AEX34583__HA

SEQ ID NO: 8254 - RNA, 1698 nt, Artificial Sequence; identical to SEQ ID NO: 8245
  derived and/or modified CDS sequence (AUadapt) from InfluenzaA__AEX34594__HA

SEQ ID NO: 8255 - RNA, 1698 nt, Artificial Sequence; identical to SEQ ID NO: 8245
  derived and/or modified CDS sequence (AUadapt) from InfluenzaA__AEX34605__HA

SEQ ID NO: 8256 - RNA, 1698 nt, Artificial Sequence; identical to SEQ ID NO: 8245
  derived and/or modified CDS sequence (AUadapt) from InfluenzaA__AEX34616__HA

SEQ ID NO: 8257 - RNA, 1698 nt, Artificial Sequence; identical to SEQ ID NO: 8245
  derived and/or modified CDS sequence (AUadapt) from InfluenzaA__AEX34627__HA

SEQ ID NO: 8258 - RNA, 1698 nt, Artificial Sequence; identical to SEQ ID NO: 8245
  derived and/or modified CDS sequence (AUadapt) from InfluenzaA__AEX34638__HA

SEQ ID NO: 8259 - RNA, 1698 nt, Artificial Sequence
  derived and/or modified CDS sequence (AUadapt) from InfluenzaA__AEX34650__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcggucgcuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggccaacggcaaccugaucgcgccgcgguucgccuucgcccucagccgcggguucggcuccggcaucaucacgagcaacgcccccauggacgagugcgacgccaagugccagacgccccagggggcgaucaacuccucgcugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacucggaggaguccaagcucaaccgcgagaagaucgacggcgugaagcuggagagcaugggcgucuaccagauccuggcgaucuacagcacgguggccuccagccucgugcugcuggucucccucggggccaucagcuucuggaugugcuccaacggcagccugcagugccggaucugcaucuga

SEQ ID NO: 8260 - RNA, 1698 nt, Artificial Sequence
  derived and/or modified CDS sequence (AUadapt) from InfluenzaA__AEX34661__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaagggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaagaaggugaacucggugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacggucgccuccagccucgugcugcuggugucccucggggccaucagcuucuggaugugcuccaacggcagccugcagugccggaucugcaucuga

SEQ ID NO: 8261 - RNA, 1698 nt, Artificial Sequence
  derived and/or modified CDS sequence (AUadapt) from InfluenzaA__AEX34672__HA
augaaggugaagcugcucguccugcugugcaccuucaccgccacguacgccgacaccaucugcaucggcuaccacgcgaacaacucgaccgacaccguggacacggugcucgacaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccucgugcucccacgacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgugcagcgggcccuguaccacacggagaacgccuacgugucggucgugagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggugaacucggucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 8262 - RNA, 1698 nt, Artificial Sequence
  derived and/or modified CDS sequence (AUadapt) from InfluenzaA__AEX34683__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccucgguguccagcuucgagcgcuucgagaucuucccgaaggaguccagcuggcccuaccacacgaccaccggggucuccgccagcugcucccacaacggcgagucguccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacucgcgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagucgcggggccuguucggggccaucgccggcuucaucgagggcggguggaccggcauggucgacgggugguacggcuaccaccaccagaacgagcagggguucggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagucgaugggcguguaccagauccuggccaucuacuccaccgucgccagcagccuggugcuccuggugucccugggggccaucagcuucuggaugugcuccaacggcagccuccagugccgcaucugcaucuga

SEQ ID NO: 8263 - RNA, 1698 nt, Artificial Sequence
  derived and/or modified CDS sequence (AUadapt) from InfluenzaA__AEX34757__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccucguggcccaaccacacgaccaccggggucuccgccagcugcucccacaacggcgggagcuccuucuacaagaaccugcuguggcucacccggaagaacggccuguaccccaaccugucgaaguccuacgccaacaacaaggagaaggaggugcucgugcuguggggcguccaccacccgcccaacaucggcgaccagcgcgcccuguaccacacggagaacgccuacgugagcguggucagcucccacuacucgcggaaguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcggucggccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcuggagcggcgcauggagaaccucaacaagaagguggacgacggcuucaucgacaucuggacguacaacgccgagcugcugguccuccuggagaacgagcggacccuggacuuccacgacucgaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacucgaccgucgccagcucccuggugcuccuggugagccugggggccaucuccuucuggaugugcagcaacggcucccuccagugccggaucugcaucuga

SEQ ID NO: 8264 - RNA, 1698 nt, Artificial Sequence
  derived and/or modified CDS sequence (AUadapt) from InfluenzaA__AEX34768__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggacuccucguggcccaaccacacgaccaccggggucuccgccagcugcucccacaacggcgagagcuccuucuacaagaaccugcuguggcucaccgggaagaacggccuguaccccaaccugucgaaguccuacgccaacaacaaggagaaggaggugcucgugcuguggggcguccaccacccgcccaacaucggcgaccagcgggcccuguaccacacggagaacgccuacgugagcguggucagcucccacuacucgcgcaaguucacccccgagaucgccaagcggcccaaggugcgcgaccagggcgggcggaucaacuacuacuggacccuccuggagcccggcgacaccaucaucuucgaggcgaacgggaaccugaucgccccgcgcuacgccuucgcccucucccggggcuucggcagcgggaucaucaacuccaacgcccccauggacgagugcgacgcgaagugccagacgccccagggcgccaucaacagcucccugcccuuccagaacgugcacccggucaccaucggggagugccccaaguacgugcgcucggccaagcugcggauggugaccggccuccgcaacauccccuccauccagagccgggggcuguucggcgccaucgccggcuucaucgagggcggguggaccgggauggucgacggcugguacggguaccaccaccagaacgagcagggcuccggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacucgaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgggagaagaucgacggcgugaagcucgaguccauggggguguaccagauccuggccaucuacucgaccgucgccagcucccuggugcuccuggugagccugggcgccaucuccuucuggaugugcagcaacgggucccuccagugccgcaucugcaucuga

SEQ ID NO: 8265 - RNA, 1698 nt, Artificial Sequence
  derived and/or modified CDS sequence (AUadapt) from InfluenzaA__AEX34779__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagcgcagcuucuaccggaaccugcuguggcucaccgggaagaacggccuguaccccaaccuguccaagucguacgccaacaacaaggagaaggaggugcucguccuguggggcgugcaccacccgcccaacaucggcaaccagaaggcccuguaccacaccgagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucgcggggguucggcuccggcaucaucaacagcaacgcccccauggacaagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccucgauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacuccaacgugaagaaccucuacgagaaggucaagucgcagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggccaucuacuccaccguggccucgagccuggugcuccuggucucccugggggccaucagcuucuggaugugcuccaacggcagccuccagugccgcaucugcaucuga

SEQ ID NO: 8266 - RNA, 1698 nt, Artificial Sequence; identical to SEQ ID NO: 4342
  derived and/or modified CDS sequence (AUadapt) from InfluenzaA__AEX34790__HA

SEQ ID NO: 8267 - RNA, 1698 nt, Artificial Sequence
  derived and/or modified CDS sequence (AUadapt) from InfluenzaA__AEX34801__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacggcgccugcuaccccggccacuucgccgacuacgaggagcugcgcgagcagcucagcuccgugucguccuucaagcgguucgagaucuucccgaaggagagcuccuggcccaaccacaccgucacgggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggggaccagaugacccuguaccacaaggagaacgccuacguguccgucgugagcagccacuacucccgcaaguucacccccgagaucgccaagcggcccaaggugcgcgaccaggagggccggaucaacuacuacuggacgcuccuggagcccggggacaccaucaucuucgaggcgucgggcaaccugaucgccccgcgcuacgccuucgcccucucccggggguucggcagcggcaucaucaacuccgacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacguguggaccuacaacgccgagcugcuggugcuccuggagaacgagcgcacccuggacuuccacgacagcaacgucaagaaccucuacgagaaggugaagaaccagcugaagaacaacgcgaaggagaucgggaacggcugcuucgaguucuaccacaagugcaacgacgagugcauggaguccgugaagaacgggacguacgacuaccccaaguacagcgaggaguccaagcugucgcgggagaagaucgacggcgucaagcucgaguccaugggcguguaccagauccuggccaucuacagcaccguggccagcucccugguccuccuggugagccugggggccaucuccuucuggaugugcagcaacggcucccuccagugccgcaucugcaucuga

SEQ ID NO: 8268 - RNA, 1698 nt, Artificial Sequence
  derived and/or modified CDS sequence (AUadapt) from InfluenzaA__AEX34812__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucgacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 8269 - RNA, 1698 nt, Artificial Sequence
  derived and/or modified CDS sequence (AUadapt) from InfluenzaA__AEX34834__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaacuccaaggagagcugguccuacaucguggagaagcccaaccccgagaacgggaccugcuaccccggccacuucgccgacuacgaggagcugcgcgagcagcucucguccgugagcuccuucaagcgguucgagaucuucccgaaggagagcuccuggcccaaccacacggucaccggggugagcgccuccugcucgcacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugucgagccacuacucccgcaaguucacgcccgagaucaccaagcggcccaaggugcgcgaccaggagggccggaucaacuacuacuggacccuccuggagcccggggacaccaucaucuucgaggccagcggcaaccugaucgccccgcgcuacgcguucgcccucucccggggguucggcagcggcaucaucaacuccaacgcccccauggacgagugcgacgccaagugccagacgccccagggggccaucaacucgucccugcccuuccagaacguccacccggugaccaucggcgagugccccaaguacgugcgcagcgcgaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacgcagaacgcgaucaacggcaucaccaacaaggugaacucggucaucgagaagaugaacacccaguucaccgccguggggaaggaguucaacaagcuggagcgccggauggagaaccucaacaagaaggucgacgacggcuucaucgacguguggacguacaacgccgagcugcuggugcuccuggagaacgagcgcacccuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgggagaagaucgacggcgucaagcucgaguccaugggcguguaccagauccuggccaucuacucgaccguggcgagcucccugguccuccuggugagccugggggccaucuccuucuggaugugcagcaacggcucccuccagugccgcaucugcaucuga

SEQ ID NO: 8270 - RNA, 1698 nt, Artificial Sequence
  derived and/or modified CDS sequence (AUadapt) from InfluenzaA__AEX34845__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccuggugcccaaggagagcugguccuacaucguggagaagcccaaccccgagaacgggaccugcuacccgggccacuucgccgacuacgaggagcugcgcgagcagcucucguccgucagcuccuucgagcgguucgagaucuuccccaaggagagcuccuggcccaaccacacggugaccggggugucggccuccugcagccacaacggcgaguccagcuucuaccgcaaccugcuguggcucaccgggaagaacggccuguaccccaaccuguccaagucguacgccaacaacaaggagaaggagguccucgugcuguggggcgugcaccacccgcccaacaucggcgaccagaaggcccuguaccacaccgagaacgccuacgucuccguggugagcagccacuacucccggaaguucacgcccgagaucgccaagcgccccaagguccgggaccaggagggccgcaucaacuacuacuggacccuccuggagccgggggacaccaucaucuucgaggcgaacggcaaccugaucgcgccccgguacgccuucgcccucucgcgcggguucggcuccggcaucaucaacagcaacgcccccauggacaagugcgacgccaagugccagacgccccagggggccaucaacuccagccugccguuccagaacgugcaccccgugaccaucggcgagugccccaaguacguccgguccgccaagcugcgcauggugaccgggcuccggaacauccccucgauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacuccaacgucaagaaccucuacgagaaggucaagucgcagcugaagaacaacgcgaaggagaucgggaacggcugcuucgaguucuaccacaagugcaacgacgagugcauggaguccgugaagaacgggaccuacgacuacccgaaguacagcgaggaguccaagcugaaccgcgagaagaucgagggcgugaagcucgagagcaugggcguguaccagauccuggccaucuacuccaccguggccucgagccugguccuccuggugucccugggggccaucagcuucuggaugugcuccaacggcagccuccagugccggaucugcaucuga

SEQ ID NO: 8271 - RNA, 1698 nt, Artificial Sequence; identical to SEQ ID NO: 4342
  derived and/or modified CDS sequence (AUadapt) from InfluenzaA__AEX34856__HA

SEQ ID NO: 8272 - RNA, 1698 nt, Artificial Sequence
  derived and/or modified CDS sequence (AUadapt) from InfluenzaA__AEX34867__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccuggugagcaaggaguccuggucguacaucguggagaagcccaaccccgagaacgggaccugcuaccccggccacuucgccgacuacgaggagcugcgcgagcagcucaucuccgucagcuccuucgagcgguucgagaucuucccgaaggagagcuccuggcccaaccacacggugaccggggugagcgccuccugcucgcacaacggcgaguccagcuucuaccgcaaccugcuguggcucaccgggaagaacggccuguaccccaaccuguccaagagcuacgccaacaacaaggagaaggagguccucgugcuguggggcgugcaccacccgcccaacaucggcgaccagaaggcccuguaccacaccgagaacgccuacgucuccguggugucgagccacuacucccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucagccgcggguucggcuccggcaucaucaacagcaacgcccccauggacaagugcgacgcgaagugccagacgccccgcggggccaucaacuccucgcugcccuuccagaacgugcacccggugaccaucggcgagugccccaaguacguccgguccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggucaacucggugaucgagaagaugaacacccaguucaccgccgucgggaaggaguucaacaagcuggagcgccggauggagaaccucaacaagaagguggacgacggcuucaucgacaucuggaccuacaacgccgagcugcuggugcuccuggagaacgagcgcacgcuggacuuccacgacuccaacgucaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgagggcgugaagcucgagagcaugggcguguaccagauccuggccaucuacuccaccguggccucgagccugguccuccuggugucccugggggccaucagcuucuggaugugcuccaacggcagccuccagugccgcaucugcaucuga

SEQ ID NO: 8273 - RNA, 1698 nt, Artificial Sequence; identical to SEQ ID NO: 4342
  derived and/or modified CDS sequence (AUadapt) from InfluenzaA__AEX34878__HA

SEQ ID NO: 8274 - RNA, 1698 nt, Artificial Sequence
  derived and/or modified CDS sequence (AUadapt) from InfluenzaA__AEX34889__HA
augaaggugaaccugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 8275 - RNA, 1698 nt, Artificial Sequence
  derived and/or modified CDS sequence (AUadapt) from InfluenzaA__AEX34900__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugucguccuucgagcgguucgagaucuucccgaaggagagcuccuggcccaaccacacggucaccggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccucgggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacccagaacgccaucaacggcgugacgaacaaggucaacagcgugaucgagaagaugaacacccaguucaccgccgucgggaaggaguucaacaagcuggagcgccggauggagaaccucaacaagaagguggacgacggcuucaucgacguguggaccuacaacgccgagcugcugguccuccuggagaacgagcgcacgcuggacuuccacgacagcaacgugaagaaccucuacgagaaggugaagaaccagcugaagaacaacgccaaggagaucgggaacggcugcuucgaguucuaccacaagugcaacgacgagugcauggaguccgucaagaacgggaccuacgacuaccccaaguacagcgaggaguccaagcugucgcgggagaagaucgacggcguggagcucgaguccaugggcguguaccagauccuggcgaucuacagcaccgucgccagcucccuggugcuccuggugagccugggggccaucuccuucuggaugugcagcaacggcucccuccagugccgcaucugcaucuga

SEQ ID NO: 8276 - RNA, 1698 nt, Artificial Sequence
  derived and/or modified CDS sequence (AUadapt) from InfluenzaA__AEX34911__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagccaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucggcuccaugggggucuaccagauccuggccaucuacucgaccguggccagcucccuggugcuccuggucagccugggcgccaucuccuucuggaugugcagcaacgggucccuccagugccggaucugcaucuga

SEQ ID NO: 8277 - RNA, 1698 nt, Artificial Sequence
  derived and/or modified CDS sequence (AUadapt) from InfluenzaA__AEX34922__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggcgcuucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucgacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 8278 - RNA, 1698 nt, Artificial Sequence; identical to SEQ ID NO: 2733
  derived and/or modified CDS sequence (AUadapt) from InfluenzaA__AEX34933__HA

SEQ ID NO: 8279 - RNA, 1698 nt, Artificial Sequence; identical to SEQ ID NO: 2733
  derived and/or modified CDS sequence (AUadapt) from InfluenzaA__AEX34944__HA

SEQ ID NO: 8280 - RNA, 1698 nt, Artificial Sequence
  derived and/or modified CDS sequence (AUadapt) from InfluenzaA__AEX34955__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggucguacaucgucgagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggugaccggggucuccgccagcugcucccacaacggcgagagcuccuucuaccgcaaccugcuguggcucaccgggaagaacggccuguaccccaaccugucgaaguccuacgccaacaacaaggagaaggaggugcucgugcuguggggcguccaccacccgcccaacaucggcgaccagaaggcccuguaccacaccgagaacgccuacgugagcguggucagcucccacuacucgcggaaguucacgcccgagaucgcgaagcgccccaaggugcgggaccaggagggccgcaucaacuacuacuggacccuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacgugcacccggucaccaucggcgagugccccaaguacgugcggucggccaagcugcgcauggugaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuucaucgacaucuggaccuacaacgcggagcugcugguccuccuggagaacgagcggacgcuggacuuccacgacucgaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacucgaccgucgccagcucccuggugcuccuggugagccugggggccaucuccuucuggaugugcagcaacggcucccuccagugccggaucugcaucuga

SEQ ID NO: 8281 - RNA, 1698 nt, Artificial Sequence
  derived and/or modified CDS sequence (AUadapt) from InfluenzaA__AEX34966__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucauguucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 8282 - RNA, 1698 nt, Artificial Sequence; identical to SEQ ID NO: 8281
  derived and/or modified CDS sequence (AUadapt) from InfluenzaA__AEX34977__HA

SEQ ID NO: 8283 - RNA, 1698 nt, Artificial Sequence; identical to SEQ ID NO: 8281
  derived and/or modified CDS sequence (AUadapt) from InfluenzaA__AEX34988__HA

SEQ ID NO: 8284 - RNA, 1698 nt, Artificial Sequence; identical to SEQ ID NO: 4342
  derived and/or modified CDS sequence (AUadapt) from InfluenzaA__AEX34999__HA

SEQ ID NO: 8285 - RNA, 1698 nt, Artificial Sequence; identical to SEQ ID NO: 8281
  derived and/or modified CDS sequence (AUadapt) from InfluenzaA__AEX35010__HA

SEQ ID NO: 8286 - RNA, 1698 nt, Artificial Sequence; identical to SEQ ID NO: 8281
  derived and/or modified CDS sequence (AUadapt) from InfluenzaA__AEX35032__HA

SEQ ID NO: 8287 - RNA, 1698 nt, Artificial Sequence; identical to SEQ ID NO: 8281
  derived and/or modified CDS sequence (AUadapt) from InfluenzaA__AEX35043__HA

SEQ ID NO: 8288 - RNA, 1698 nt, Artificial Sequence
  derived and/or modified CDS sequence (AUadapt) from InfluenzaA__AEX35054__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccaacaucggcgaccagaaggcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccaucauguucgaggcgaacggcaaccugaucgccccgcgguacgccuucgcccucaaccgcggguucggcuccggcaucaucaacagcaacgcccccauggacaagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccucgauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagucgcagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccguggccucgagccuggugcuccuggucucccugggggccaucagcuucuggaugugcuccaacggcagccuccagugccggaucugcaucuga

SEQ ID NO: 8289 - RNA, 1698 nt, Artificial Sequence; identical to SEQ ID NO: 8281
  derived and/or modified CDS sequence (AUadapt) from InfluenzaA__AEX35065__HA

SEQ ID NO: 8290 - RNA, 1698 nt, Artificial Sequence; identical to SEQ ID NO: 2733
  derived and/or modified CDS sequence (AUadapt) from InfluenzaA__AEX35076__HA

SEQ ID NO: 8291 - RNA, 1698 nt, Artificial Sequence
  derived and/or modified CDS sequence (AUadapt) from InfluenzaA__AEX35087__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugucguccuucaagcgguucgagaucuucccgaaggagagcuccuggcccaaccacacggucaccggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccucgggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugucgcgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 8292 - RNA, 1698 nt, Artificial Sequence
  derived and/or modified CDS sequence (AUadapt) from InfluenzaA__AEX35098__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucaugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucacgaacaaggugaacucggugaucgagaagaugaacacccaguucaccgccgucgggaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacucgaccgucgccagcucccuggugcuccuggugagccugggggccaucuccuucuggaugugcagcaacggcucccuccagugccggaucugcaucuga

SEQ ID NO: 8293 - RNA, 1698 nt, Artificial Sequence
  derived and/or modified CDS sequence (AUadapt) from InfluenzaA__AEX35109__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccagcccccgaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 8294 - RNA, 1698 nt, Artificial Sequence
  derived and/or modified CDS sequence (AUadapt) from InfluenzaA__AEX35120__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccgcgagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 8295 - RNA, 1698 nt, Artificial Sequence; identical to SEQ ID NO: 8038
  derived and/or modified CDS sequence (AUadapt) from InfluenzaA__AEX35131__HA

SEQ ID NO: 8296 - RNA, 1698 nt, Artificial Sequence; identical to SEQ ID NO: 8038
  derived and/or modified CDS sequence (AUadapt) from InfluenzaA__AEX35142__HA

SEQ ID NO: 8297 - RNA, 1698 nt, Artificial Sequence
  derived and/or modified CDS sequence (AUadapt) from InfluenzaA__AEX35153__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugucguccuucgagcgguucgagaucuucccgaaggagagcuccuggcccaaccacacggucaccggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggcaaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccucgggcaaccugaucgcgccgcgcuacgccuucgcccucucccggggguucggcagcggcaucaucaacuccaacgcccccauggacgagugcgacgccaagugccagacgccccagggggcgaucaacagcaaccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggucgggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacuccaacgucaagagccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugucgcgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 8298 - RNA, 1698 nt, Artificial Sequence
  derived and/or modified CDS sequence (AUadapt) from InfluenzaA__AEX35164__HA
augaaggugaagcugcucguccugcugugcgccuucaccgccaccuacgcggacacgaucugcaucggcuaccacgccaacaacucgaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacaccgucacggggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaacgccuacgucagcguggugagcucccacuacucgcggaaguucacccccgagaucgcgaagcgccccaagguccgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacgcaguucaccgccgucgggaaggaguucaacaagcuggagcggcgcauggagaaccucaacaagaagguggacgacggcuucaucgacaucuggaccuacaacgcggagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagucgaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 8299 - RNA, 1698 nt, Artificial Sequence
  derived and/or modified CDS sequence (AUadapt) from InfluenzaA__AEX35175__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccguggaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccggggugaccgccuccugcucgcacaacggcaaguccagcuucuaccgcaaccugcuguggcucacggggaagaacggccuguaccccaaccuguccaagagcuacgccaacaacaaggagaaggaggugcucguccuguggggcgugcaccacccgcccaacaucggggaccagcgggcccuguaccacaccgagaacgccuacguguccgucgugucgagccacuacucccgccgguucacccccgagaucgccaagcgccccaaggugcgggaccaggagggccgcaucaacuacuacuggacccuccuggagcccggggacacgaucaucuucgaggcgaacggcaaccugaucgccccgcgguucgccuucgcccucaaccgcggguucggcagcggcaucaucaccuccaacgcccccauggacgggugcgacgcgaagugccagacgccccagggcgccaucaacagcucccugcccuuccagaacguccacccggugaccaucggggagugccccaaguacgugcggucggccaagcugcgcauggccaccggccuccggaacauccccuccauccagagccgcgggcuguucggcgccaucgcgggcuucaucgagggcggguggaccgggauggucgacggcugguacggguaccaccaccagaacgagcagggcuccggcuacgccgccgaccagaaguccacccagaacgccaucaacgggaucaccaacaaggugaacagcgugaucgagaagaugaacacgcaguucaccgccgucggcaaggaguucucgaagcuggagcggcgcauggagaaccucaacaagaagguggacgacggguuccuggacaucuggaccuacaacgcggagcugcucguccugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgcgagaagaucgacggcgugaagcuggagagcauggggguguaccagauccuggccaucuacuccaccgucgccucgagccucgugcugcuggugucccucggcgccaucagcuucuggaugugcuccaacgggagccugcagugccggaucugcaucuga

SEQ ID NO: 8300 - RNA, 1698 nt, Artificial Sequence
  derived and/or modified CDS sequence (AUadapt) from InfluenzaA__AEX35186__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccucguggcccaaccacacgaccaccggggucuccgccagcugcucccacaacggcgagagcuccuucuacaagaaccugcuguggcucaccgggaagaacggccuguaccccaaccugucgaaguccuacgccaacaacaaggagaaggaggugcucgugcuguggggcguccaccacccgcccaacaucggcaaccagcgggcccuguaccacacggagaacgccuacgugagcguggucagcucccacuacucgcgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcucggccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacucgaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggccaucuacucgaccgucgccagcucccuggugcuccuggugagccugggggccaucuccuucuggaugugcagcaacggcucccuccagugccgcaucugcaucuga

SEQ ID NO: 8301 - RNA, 1698 nt, Artificial Sequence; identical to SEQ ID NO: 8300
  derived and/or modified CDS sequence (AUadapt) from InfluenzaA__AEX35197__HA

SEQ ID NO: 8302 - RNA, 1698 nt, Artificial Sequence; identical to SEQ ID NO: 2733
  derived and/or modified CDS sequence (AUadapt) from InfluenzaA__AEX35208__HA

SEQ ID NO: 8303 - RNA, 1701 nt, Artificial Sequence
  derived and/or modified CDS sequence (AUadapt) from InfluenzaA__AEX35219__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgggugaccguguccaccaagcgcucgcagcagaccgucaucccgaacaucggcucccggcccugggugcgcgacgugagcucccggaucucgaucuacuggacgaucgucaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacucggaggggaccggccaggccgcggaccugaaguccacgcaggccgccaucaaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccauguccugcuuccugcugugcgugguccuccugggcuucaucaugugggccugccagaaggggaacauccgcugcaacaucugcaucuga

SEQ ID NO: 8304 - RNA, 1698 nt, Artificial Sequence; identical to SEQ ID NO: 8245
  derived and/or modified CDS sequence (AUadapt) from InfluenzaA__AEX35230__HA

SEQ ID NO: 8305 - RNA, 1701 nt, Artificial Sequence; identical to SEQ ID NO: 2142
  derived and/or modified CDS sequence (AUadapt) from InfluenzaA__AEX35241__HA

SEQ ID NO: 8306 - RNA, 1698 nt, Artificial Sequence; identical to SEQ ID NO: 8245
  derived and/or modified CDS sequence (AUadapt) from InfluenzaA__AEX35263__HA

SEQ ID NO: 8307 - RNA, 1698 nt, Artificial Sequence; identical to SEQ ID NO: 8245
  derived and/or modified CDS sequence (AUadapt) from InfluenzaA__AEX35274__HA

SEQ ID NO: 8308 - RNA, 1701 nt, Artificial Sequence; identical to SEQ ID NO: 2040
  derived and/or modified CDS sequence (AUadapt) from InfluenzaA__AEX35285__HA

SEQ ID NO: 8309 - RNA, 1701 nt, Artificial Sequence; identical to SEQ ID NO: 8206
  derived and/or modified CDS sequence (AUadapt) from InfluenzaA__AEX35296__HA

SEQ ID NO: 8310 - RNA, 1701 nt, Artificial Sequence
  derived and/or modified CDS sequence (AUadapt) from InfluenzaA__AEX35307__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccuggucgccagcuccgggacgcucgaguucaacaacgagucguucaacuggaccggcgugacccagaacgggaccuccagcgccugcaagcgccgguccaacaagucguucuucucccgccugaacuggcugacgcaccucaaguacaaguaccccgcccugaacgugaccaugcccaacaacgagaaguucgacaagcuguacaucuggggcguccaccaccccgggaccgacucggaccagaucucccucuacgcgcaggccagcggccggaucaccgugucgacgaagcgcucccagcagaccgugaucccgaacaucggcagccggccccgcguccgggacguguccucgcgcaucuccaucuacuggaccaucgugaagcccggggacauccugcugaucaacucgaccggcaaccucaucgcgccccggggguacuucaagauccgcuccggcaagagcuccaucaugcggucggacgccccgaucggcaagugcaacuccgagugcaucacgcccaacgggagcauccccaacgacaagcccuuccagaacgucaaccgcaucaccuacggcgccugcccgcgguacgugaagcagaacacccugaagcuggccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagucgacccaggcggccaucaaccagaucaacggcaagcugaaccggcugaucggcaagaccaacgagaaguuccaccagaucgagaaggaguucuccgagguggaggggcgcauccaggaccucgagaaguacguggaggacacgaagaucgaccuguggucguacaacgccgagcugcucgucgcccuggagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcguggagcucaaguccggcuacaaggacuggauccuguggaucucguucgccaucagcugcuuccugcucugcgucgugcugcugggguucaucaugugggccugccagaagggcaacauccggugcaacaucugcaucuga

SEQ ID NO: 8311 - RNA, 1701 nt, Artificial Sequence; identical to SEQ ID NO: 8206
  derived and/or modified CDS sequence (AUadapt) from InfluenzaA__AEX35318__HA

SEQ ID NO: 8312 - RNA, 1701 nt, Artificial Sequence
  derived and/or modified CDS sequence (AUadapt) from InfluenzaA__AEX35329__HA
augaagaccaucaucgcccugucguacuuccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucaacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccucgaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 8313 - RNA, 1701 nt, Artificial Sequence
  derived and/or modified CDS sequence (AUadapt) from InfluenzaA__AEX35340__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggucgcucgucgccuccucggggacgcuggaguucaacaacgaguccuucaacuggaccggcgugacccagaacgggaccagcuccgccugcaagcgccggucgaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugucgacgaagcgcucgcagcagaccgugaucccgaacaucggcucccggccccgcguccgggacgugagcucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 8314 - RNA, 1701 nt, Artificial Sequence; identical to SEQ ID NO: 8206
  derived and/or modified CDS sequence (AUadapt) from InfluenzaA__AEX35351__HA

SEQ ID NO: 8315 - RNA, 1701 nt, Artificial Sequence; identical to SEQ ID NO: 8206
  derived and/or modified CDS sequence (AUadapt) from InfluenzaA__AEX35362__HA

SEQ ID NO: 8316 - RNA, 1701 nt, Artificial Sequence; identical to SEQ ID NO: 2040
  derived and/or modified CDS sequence (AUadapt) from InfluenzaA__AEX35373__HA

SEQ ID NO: 8317 - RNA, 1701 nt, Artificial Sequence
  derived and/or modified CDS sequence (AUadapt) from InfluenzaA__AEX35384__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugagcgugaccaugcccaacaacgagaaguucgacaagcucuacaucuggggcguccaccaccccgggaccgacaacgaccagaucucccuguacgcgcaggccucgggccggaucaccgugucgacgaagcgcucccagcagaccgugaucccgaacaucggcagccggacccgcguccgggacgugcccucccgcaucucgaucuacuggaccaucgugaagcccggggacauccugcucaucaacuccacgggcaaccugaucgcgccccggggguacuucaagauccgcucgggcaaguccagcaucaugcgguccgacgccccgaucggcaagugcaacucggagugcaucacccccaacggguccauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagacgaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 8318 - RNA, 1701 nt, Artificial Sequence
  derived and/or modified CDS sequence (AUadapt) from InfluenzaA__AEX35395__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaaguggaaccuguucguggagcgcucgaaggccuacuccaacugcuaccccuacgacgugccggacuacgcgagccugcggucccucgucgccucguccggcacgcuggaguucaacaacgagucguucaacuggaccggggugacccagaacggcaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccgggcggaucaccgugagcacgaagcgcucgcagcagaccgugaucccgaacaucggcucccggccccgcguccgggacgugcccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcucgauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcacguacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 8319 - RNA, 1701 nt, Artificial Sequence; identical to SEQ ID NO: 2040
  derived and/or modified CDS sequence (AUadapt) from InfluenzaA__AEX35406__HA

SEQ ID NO: 8320 - RNA, 1701 nt, Artificial Sequence; identical to SEQ ID NO: 2040
  derived and/or modified CDS sequence (AUadapt) from InfluenzaA__AEX35417__HA

SEQ ID NO: 8321 - RNA, 1701 nt, Artificial Sequence
  derived and/or modified CDS sequence (AUadapt) from InfluenzaA__AEX35428__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaagaagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccgacaagucguucuucucccgccucaacuggcugcaccagcugaaguacaaguaccccgcgcucaacgugaccaugcccaacaacgagaaguucgacaagcuguacaucuggggcguccaccaccccgggacggacagcgaccagaucucccuguacgcccaggccucgggccggaucaccgugagcaccaagcgcucccagcagaccgugaucccgaacaucggcucgcggccccgcguccgggacguguccucgcgcaucuccaucuacuggacgaucgugaagcccggggacauccucuucaucaacagcaccggcaaccugaucgcgccccggggguacuucaagauccgcuccggcaagucguccaucaugcggagcgacgccccgaucgacaagugcaacuccgagugcaucacccccaacggcucgauccccaacgacaagcccuuccagaacgucaaccgcaucaccuacggggccugcccgcgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacuccgaggggaccggccaggccgcggaccugaaguccacgcaggccgccaucaaccagaucaacgggaagcugaaccggcucaucggcaagaccaacgagaaguuccaccagaucgagaaggaguucuccgagguggagggccgcauccaggaccuggagaaguacguggaggacaccaagaucgaccuguggucguacaacgccgagcuccuggucgcccuggagaaccagcacaccaucgaccucacggacuccgagaugaacaagcuguucgagcggaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucucguucgccaucagcugcuuccuccugugcgucgcccugcucggcuucaucaugugggcgugccagaaggggaacauccggugcaacaucugcaucuga

SEQ ID NO: 8322 - RNA, 1698 nt, Artificial Sequence
  derived and/or modified CDS sequence (AUadapt) from InfluenzaA__AEX35439__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucggccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 8323 - RNA, 1701 nt, Artificial Sequence
  derived and/or modified CDS sequence (AUadapt) from InfluenzaA__AEX35450__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagaacuucaacuggaccggcgugacccagaacgggaccagcuccgccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugucgacgaagcgcucccagcagaccgugaucccgaacaucggcucgcggccccgcguccggaacauccccagccgcaucuccaucuacuggaccaucgugaagcccggggacauccugcucaucaacucgaccggcaaccugaucgccccgcggggguacuucaagauccaguccggcaagagcuccaucaugcgcucggacgcccccaucggcaagugcaacuccgagugcaucacgcccaacgggucgauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 8324 - RNA, 1701 nt, Artificial Sequence; identical to SEQ ID NO: 875
  derived and/or modified CDS sequence (AUadapt) from InfluenzaA__AEX35461__HA

SEQ ID NO: 8325 - RNA, 1701 nt, Artificial Sequence
  derived and/or modified CDS sequence (AUadapt) from InfluenzaA__AEX35472__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacgacuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 8326 - RNA, 1701 nt, Artificial Sequence; identical to SEQ ID NO: 875
  derived and/or modified CDS sequence (AUadapt) from InfluenzaA__AEX35483__HA

SEQ ID NO: 8327 - RNA, 1701 nt, Artificial Sequence
  derived and/or modified CDS sequence (AUadapt) from InfluenzaA__AEX35494__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggccugcagaacaagaagugggaccuguucguggagcgcucgaaggccuacuccaacugcuaccccuacgacgugccggacuacgcgagccuccggucccuggucgccucguccgggacgcuggaguucaacaacgagagcuucaacuggaccggcgugacccagaacgggaccuccucggccugcaagcgccgguccaacaacucguucuucucccgccucaacuggcugacgcaccugaaguucaaguaccccgcccucaacgugaccaugcccaacaacgagaaguucgacaagcuguacaucuggggcguccaccaccccgggaccgacaacgaccagaucuuccuguacgcgcaggccagcggccggaucaccguguccacgaagcgcucgcagcagaccgugaucccgaacaucggcucgcggccccgcguccggaacauccccucccgcaucagcaucuacuggaccaucgugaagcccggggacauccuccugaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccucaagcuggcgaccgggaugcgcaacgugcccgagaagcagacgcggggcaucuucggggccaucgccggcuucaucgagaacggcugggaggggaugauggacggcugguacggguuccgccaccagaacucggagggcaucgggcaggccgccgaccugaaguccacccaggcggccaucaaccagaucaacggcaagcucaaccggcugaucggcaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacucggagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 8328 - RNA, 1701 nt, Artificial Sequence
  derived and/or modified CDS sequence (AUadapt) from InfluenzaA__AEX35505__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacgacuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccugagcgggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucaaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacucggagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 8329 - RNA, 1701 nt, Artificial Sequence
  derived and/or modified CDS sequence (AUadapt) from InfluenzaA__AEX35516__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggccugcagaacaagaagugggaccuguucguggagcgcucgaaggccuacuccaacugcuaccccuacgacgugccggacuacgcgagccuccggucccuggucgccucguccgggacgcuggaguucaacaacgagagcuucaacuggaccggcgugacccagaacgggaccuccucggccugcaagcgccgguccaacaacucguucuucucccgccucaacuggcugacgcaccugaaguucaaguaccccgcccucaacgugaccaugcccaacaacgagaaguucgacaagcuguacaucuggggcguccaccaccccgggaccgacaacgaccagaucuuccuguacgcgcaggccagcggccggaucaccguguccacgaagcgcucgcagcagaccgugaucccgaacaucggcucgcggccccgcguccggaacauccccucccgcaucagcaucuacuggaccaucgugaagcccggggacauccuccugaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccucaagcuggcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcucaaccggcugaucggcaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacucggagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 8330 - RNA, 1701 nt, Artificial Sequence
  derived and/or modified CDS sequence (AUadapt) from InfluenzaA__AEX35527__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucucgcugcggucccucguggcgagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucucgcuguacgcccaggcguccggccggaucaccgugagcacgaagcgcucgcagcagaccgucaucccgaacaucggcucccggccccgcgugcgggacauccccagccgcaucuccaucuacuggaccaucgugaagcccggggacauccugcucaucaacucgaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 8331 - RNA, 1701 nt, Artificial Sequence
  derived and/or modified CDS sequence (AUadapt) from InfluenzaA__AEX35549__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgcggcuccaacaacucguucuucucccggcugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccuccggcaagaucaccgucucgacgaagcgcucgcagcagaccgugaucccgaacaucgggucccggccccgcgugcgggacauccccagccgcaucuccaucuacuggaccaucgucaagcccggcgacauccugcucaucaacucgaccgggaaccugaucgccccgcggggcuacuucaagauccgcuccggcaagagcuccaucaugcggucggacgcccccaucgacaagugcaacuccgagugcaucacgcccaacgggucgauccccaacgacaagccguuccagaacgugaacaagaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 8332 - RNA, 1701 nt, Artificial Sequence
  derived and/or modified CDS sequence (AUadapt) from InfluenzaA__AEX35560__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucucgcugcggucccucguggcgagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucagccuguacgcccaggcguccggccggaucaccgugucgacgaagcgcagccagcagaccgucaucccgaacaucggcucccggccccgcgugcgggacauccccucgcgcaucuccaucuacuggaccaucgugaagcccggggacauccugcucaucaacagcaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacuccgugggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 8333 - RNA, 1701 nt, Artificial Sequence
  derived and/or modified CDS sequence (AUadapt) from InfluenzaA__AEX35571__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagccgggccuacuccaacugcuaccccuacgacgugccggacuacgcgucgcugcgcucccucgucgccagcuccgggacgcuggaguucaacaacgagucguucaacuggaccggcgugacccagaacgggaccuccucggccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccgcaucaccguguccacgaagcggagccagcagaccgugaucccgaacaucggcucgcgcccccggguccgcaacauccccucccggaucagcaucuacuggaccaucgugaagcccggggacauccugcucaucaacuccaccggcaaccugaucgccccgcgcggguacuucaagauccggucgggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 8334 - RNA, 1701 nt, Artificial Sequence; identical to SEQ ID NO: 875
  derived and/or modified CDS sequence (AUadapt) from InfluenzaA__AEX35582__HA

SEQ ID NO: 8335 - RNA, 1701 nt, Artificial Sequence
  derived and/or modified CDS sequence (AUadapt) from InfluenzaA__AEX35593__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcgccccugggcaagugcaacagcgagugcaucacgcccaacggguccauccccaacgacaagccguuccagaacgugaaccgcaucaccuacggcgccugcccccgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcucaaccggcugaucggcaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacucggagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 8336 - RNA, 1701 nt, Artificial Sequence; identical to SEQ ID NO: 2617
  derived and/or modified CDS sequence (AUadapt) from InfluenzaA__AEX35604__HA

SEQ ID NO: 8337 - RNA, 1701 nt, Artificial Sequence
  derived and/or modified CDS sequence (AUadapt) from InfluenzaA__AEX35615__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacaucgaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8338 - RNA, 1701 nt, Artificial Sequence; identical to SEQ ID NO: 2679
  derived and/or modified CDS sequence (AUadapt) from InfluenzaA__AEX35626__HA

SEQ ID NO: 8339 - RNA, 1701 nt, Artificial Sequence
  derived and/or modified CDS sequence (AUadapt) from InfluenzaA__AEX35637__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgcggcuccgacaacucguucuucuccaagcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcgcaggccucgggccggaucaccguguccacgaagcgcagccagcagaccgugauccccaacaucgggucgcggccccgcguccggaacauccccucccgcaucucgaucuacuggaccaucgugaagccgggcgacauccugcugaucaacuccaccgggaaccucaucgcgccccggggcuacuucaagauccgcagcggcaaguccucgaucaugcgguccgacgcccccaucgggaagugcaacagcgagugcaucacgcccaacggcuccaucccgaacgacaagcccuuccagaacgugaaccgcaucaccuacggggccugcccccgguacgucaagcagaacacccugaagcuggccaccggcaugcgcaacgugcccgagaagcagacgcgggggaucuucggcgccaucgccggcuucaucgagaacgggugggagggcaugguggacgggugguacggcuuccgccaccagaacucggaggggaucggccaggccgccgaccucaaguccacccaggcggccaucaaccagaucaacggcaagcugaaccggcugaucgggaagaccaacgagaaguuccaccagaucgagaaggaguucucggaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagucgggguacaaggacuggauccuguggaucuccuucgccaucagcugcuuccugcucugcguggcccugcugggcuucaucaugugggccugccagaaggggaacauccggugcaacaucugcaucuga

SEQ ID NO: 8340 - RNA, 1701 nt, Artificial Sequence; identical to SEQ ID NO: 2679
  derived and/or modified CDS sequence (AUadapt) from InfluenzaA__AEX35648__HA

SEQ ID NO: 8341 - RNA, 1701 nt, Artificial Sequence
  derived and/or modified CDS sequence (AUadapt) from InfluenzaA__AEX36102__HA
augaagaccaucaucgcccugucguacauccucugccugguguucgcccagaagcugcccggcaacaacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8342 - RNA, 1701 nt, Artificial Sequence; identical to SEQ ID NO: 2160
  derived and/or modified CDS sequence (AUadapt) from InfluenzaA__AEX36113__HA

SEQ ID NO: 8343 - RNA, 1701 nt, Artificial Sequence; identical to SEQ ID NO: 2679
  derived and/or modified CDS sequence (AUadapt) from InfluenzaA__AEX36124__HA

SEQ ID NO: 8344 - RNA, 1701 nt, Artificial Sequence
  derived and/or modified CDS sequence (AUadapt) from InfluenzaA__AEX36146__HA
augaagaccaucaucgcccugucguacauccucugccuggugcuggcccagaagcuccccggcgacgacaacuccaccgcgacgcugugccuggggcaccacgccgucccgaacggcaccaucgugaagaccaucaccaacgaccagaucgaggugacgaacgccaccgagcucguccagucguccagcaccggggagaucugcgacucgccccaccagauccuggacggcgagaacugcacccugaucgacgcccuccugggggacccccagugcgacggcuuccagaacaagaagugggaccuguucguggagcgcucgaaggccuacuccaacugcuaccccuacgacgugccggacuacgcgagccuccggucccuggucgccucguccggcacgcuggaguucaacaacgagagcuucaacuggaccggggugacccagaacggcaccuccucggccugcauccgccgguccaacaacucguucuucucccgccucaacuggcugacgcaccugaaguucaaguaccccgcccucaacgugaccaugcccaacaacgagcaguucgacaagcuguacaucuggggcguccaccaccccgggaccgacaacgaccagaucuuccuguacgcgcaggccagcgggcggaucaccguguccacgaagcgcucgcagcagaccgugaucccgaacaucggcucgcggccccgcguccggaacauccccucccgcaucagcaucuacuggaccaucgugaagcccggcgacauccuccugaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacucggagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 8345 - RNA, 1701 nt, Artificial Sequence
  derived and/or modified CDS sequence (AUadapt) from InfluenzaA__AEX36168__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacugggccggcgugacccagaacgggaccuccagcgccugcaagcgcggcuccgacaacucguucuucucccggcugaacuggcucacccaccugaaguucaaguaccccgcgcugaacgugacgaugcccaacaacgaggaguucgacaagcucuacaucuggggcguccaccaccccgggaccgacaacgaccagaucuuccuguacgcccaggccagcggccgcaucaccguguccaccaagcggucgcagcagacggugaucccgaacaucgggagccgcccccggguccgcaacauccccucccggaucucgaucuacuggaccaucgugaagcccggcgacauccugcucaucaacuccaccgggaaccugaucgccccgcgcggcuacuucaagauccggagcggcaaguccucgaucaugcgcuccgacgcccccaucgggaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggcuucaucgagaacgggugggagggcaugguggacgggugguacggcuuccggcaccagaacucggaggggaucggccaggccgcggaccugaaguccacgcaggccgccaucgaccagaucaacggcaagcugaacaagcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgggagaacgcggaggacauggggaacggcugcuucaagaucuaccacaagugcgacaacgccugcaucggguccauccgcaacggcaccuacgaccacgacgucuaccgggacgaggcccucaacaaccgcuucaagaucaagggcguggagcugaaguccggguacaaggacuggauccuguggaucuccuucgccaucagcugcuuccuccugugcguggcccugcucggcuucaucaugugggcgugccagaaggggaacaucaagugcaacaucugcaucuga

SEQ ID NO: 8346 - RNA, 1701 nt, Artificial Sequence; identical to SEQ ID NO: 2679
  derived and/or modified CDS sequence (AUadapt) from InfluenzaA__AEX36179__HA

SEQ ID NO: 8347 - RNA, 1701 nt, Artificial Sequence; identical to SEQ ID NO: 8228
  derived and/or modified CDS sequence (AUadapt) from InfluenzaA__AEX36190__HA

SEQ ID NO: 8348 - RNA, 1701 nt, Artificial Sequence; identical to SEQ ID NO: 8223
  derived and/or modified CDS sequence (AUadapt) from InfluenzaA__AEX36201__HA

SEQ ID NO: 8349 - RNA, 1701 nt, Artificial Sequence
  derived and/or modified CDS sequence (AUadapt) from InfluenzaA__AEX36212__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucgaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccucgggccgcaucaccguguccacgaagaucagccagcagaccgugaucccgaacaucgggucgcggccccgcguccggaacauccccucccgcaucagcaucuacuggaccaucgugaagcccggcgacauccugcugaucaacuccaccgggaaccucaucgccccgcggggcuacuucaagauccgcucgggcaaguccagcaucaugcgguccgacgcccccaucgggaagugcaacucggagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggcuucaucgagaacgggugggagggcaugguggacgggugguacggcuuccgccaccagaacagcgaggggaucggccaggccgccgaccucaaguccacccaggcggccaucgaccagaucaacggcaagcugaaccggcugaucgggaagaccaacgagaaguuccaccagaucgagaaggaguucucggaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaagggcguggagcucaagucgggguacaaggacuggauccuguggaucuccuucgccaucagcugcuuccugcucugcguggcccugcugggcuucaucaugugggccugccagaaggggaacauccgcugcaacaucugcaucuga

SEQ ID NO: 8350 - RNA, 1701 nt, Artificial Sequence; identical to SEQ ID NO: 8223
  derived and/or modified CDS sequence (AUadapt) from InfluenzaA__AEX36223__HA

SEQ ID NO: 8351 - RNA, 1701 nt, Artificial Sequence
  derived and/or modified CDS sequence (AUadapt) from InfluenzaA__AEX36234__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgcggcuccgacaacucguucuucuccaagcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucgggucgcggccccgcguccggaacauccccucccgcaucagcaucuacuggaccaucgugaagcccggcgacauccugcucaucaacuccaccgggaaccugaucgccccgcggggcuacuucaagauccgcucgggcaaguccagcaucaugcgguccgacgcccccaucgggaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggcuucaucgagaacgggugggagggcaugguggacgggugguacggcuuccgccaccagaacucggaggggaucggccaggccgccgaccugaaguccacccaggcggccaucaaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugccucaagaucuaccacaagugcgacaacgcgugcaucggguccauccggaacggcaccuacgaccacgacgucuaccgcgacgaggcccugaacaaccgcuuccagaucaagggcguggagcugaaguccggguacaaggacuggauccucuggaucuccuucgccaucagcugcuuccugcugugcguggcccuccugggcuucaucaugugggccugccagaaggggaacauccggugcaacaucugcaucuga

SEQ ID NO: 8352 - RNA, 1701 nt, Artificial Sequence
  derived and/or modified CDS sequence (AUadapt) from InfluenzaA__AEX36245__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaagacguacucgaacugcuaccccuacgacgugccggacuacgccucccugcggagccucgucgcguccucggggacccuggaguucaacaacgaguccuucaacuggaccggcgugacccagaacgggacgagcuccgccugcaagcgcggcucgaacaacuccuucuucucgcggcugaacuggcucacccacuccaaguucaaguaccccgcccugaacgugaccaugcccaacaacgaggaguucgacaagcuguacaucuggggcguccaccaccccgggaccgacaacgaccagaucuuccucuacgcccaggcgagcggccgcaucacgguguccaccaagcggucgcagcagaccgugaucccgaacaucgggagccgcccccggguccgcaacauccccucccggaucucgaucuacuggaccaucgugaagcccggcgacauccugcugaucaacuccacggggaaccucaucgccccgcgcggcuacuucaagauccggagcggcaaguccucgaucaugcgcuccgacgcccccaucgggaagugcaacucggagugcaucacccccaacggcuccauccccaacgacaagccguuccagaacgugaaccggaucaccuacggggccugcccccgcuacgucaagcagaacacccugaagcuggccacgggcaugcggaacgugcccgagaagcagacccgcgggaucuucggcgcgaucgccggcuucaucgagaacgggugggagggcaugguggacgggugguacggcuuccggcaccagaacagcgaggggaucggccaggccgccgaccucaaguccacccaggccgcgaucgaccagaucaacggcaagcugaaccgccugaucgggaagaccaacgagaaguuccaccagaucgagaaggaguucucggaggucgagggccggauccaggaccucgagaaguacguggaggacacgaagaucgaccugugguccuacaacgccgagcugcucguggcccuggagaaccagcacaccaucgaccugaccgacagcgagaugaacaagcuguucgagaagaccaagaagcagcuccgcgagaacgccgaggacauggggaacggcugcuucaagaucuaccacaagugcgacaacgccugcaucggguccauccggaacggcacguacgaccacgacgucuaccgcgacgaggcgcugaacaaccgcuuccagaucaagggcguggagcucaagucgggguacaaggacuggauccuguggaucuccuucgccaucagcugcuuccugcucugcguggcccugcugggcuucaucaugugggccugccagaaggggaacauccggugcaacaucugcaucuga

SEQ ID NO: 8353 - RNA, 1701 nt, Artificial Sequence
  derived and/or modified CDS sequence (AUadapt) from InfluenzaA__AEX36256__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccucgcugcggucccucgucgcgagcuccggcacccuggaguucaacaacgagucguucaacuggaccggggugacccagaacggcacguccucggccugcauccgcaaguccaacaacagcuucuucucccggcugaacuggcucacccaccugaaguucaaguaccccgcccugaacgugaccaugcccaacaacgagcaguucgacaagcucuacaucuggggcguccaccaccccgggaccgacaacgaccagaucuuccuguacgcccaggcgucggggcgcaucacgguguccaccaagcggagccagcagaccgugaucccgaacaucggcucgcgcccccggguccgcaacauccccucccggaucagcaucuacuggaccaucgugaagcccggcgacauccugcucaucaacuccacggggaaccugaucgccccgcgcggcuacuucaagauccggucggggaaguccucgaucaugcgcuccgacgcccccaucggcaagugcaacagcgagugcaucacccccaacggcuccauccccaacgacaagccguuccagaacgugaaccggaucaccuacggggccugcccccgcuacgucaagcagaacacccugaagcucgccacgggcaugcggaacgugcccgagaagcagacccgcgggaucuucggcgcgaucgccggguucaucgagaacggcugggagggcaugguggacgggugguacggcuuccggcaccagaacucggaggggcgcggccaggccgccgaccugaaguccacccaggccgcgaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgccugcaucggguccauccgcaacggcacguacgaccacgacgucuaccgcgacgaggcgcucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8354 - RNA, 1701 nt, Artificial Sequence; identical to SEQ ID NO: 8223
  derived and/or modified CDS sequence (AUadapt) from InfluenzaA__AEX36267__HA

SEQ ID NO: 8355 - RNA, 1701 nt, Artificial Sequence
  derived and/or modified CDS sequence (AUadapt) from InfluenzaA__AEX36289__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucgaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccucgggccgcaucaccguguccacgaagaucucgcagcagaccgugaucccgaacaucgggagccggccccgcguccggaacauccccucccgcaucucgaucuacuggaccaucgugaagcccggcgacauccugcugaucaacuccaccgggaaccucaucgccccgcggggcuacuucaagauccgcagcggcaaguccucgaucaugcgguccgacgcccccaucgggaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggcuucaucgagaacgggugggagggcaugguggacgggugguacggcuaccgccaccagaacucggaggggaucggccaggccgccgaccucaaguccacccaggcggccaucgaccagaucaacggcaagcugaaccggcugaucgggaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacucggagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaagggcguggagcucaagcugggguacaaggacuggauccuguggaucagcuucgccaucuccugcuuccuccugugcguggcccugcucggcuucaucaugugggccugccagaaggggaacauccgcugcaacaucugcaucuga

SEQ ID NO: 8356 - RNA, 1701 nt, Artificial Sequence
  derived and/or modified CDS sequence (AUadapt) from InfluenzaA__AEX36300__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucuccaacgagagcuucaacuggaccggcgugacccagaacgggaccuccucggccugcaagcgcggcuccaacaacagcuucuucuccaagcugaacuggcucacgcacucgaaguucaaguaccccgcccugaacgugaccaugcccaacaacgaggaguucgacaagcuguacaucuggggcguccaccaccccgggaccgacaacgaccagaucuuccucuacgcgcaggccuccggccggaucaccgugagcacgaagcgcucgcagcagaccgugaucccgaacaucgggucccggccccgcguccggaacauccccagccgcaucuccaucuacuggaccaucgugaagcccggcgacauccugcugaucaacucgaccgggaaccucaucgccccgcggggcuacuucaagauccgcuccggcaagagcuccaucaugcggucggacgcccccaucgggaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggcuucaucgagaacgggugggagggcaugguggacgggugguacggcuuccgccaccagaacuccgaggggaucggccaggccgccgaccucaagucgacccaggcggccaucgaccagaucaacggcaagcugaaccggcugaucgggaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccgcugcaacaucugcaucuga

SEQ ID NO: 8357 - RNA, 1701 nt, Artificial Sequence
  derived and/or modified CDS sequence (AUadapt) from InfluenzaA__AEX36311__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacugggccggcgugacccagaacgggaccuccagcgccugcaagcgcggcuccaacaacucguucuucucccggcugaacuggcucacccaccugaaguucaaguaccccgcgcugaacgugacgaugcccaacaacgaggaguucgacaagcucuacaucuggggcguccaccaccccgggaccgacaacgaccagaucuuccuguacgcccaggccagcggccgcaucaccguguccaccaagcggucgcagcagacggugaucccgaacaucgggagccgcccccggguccgcaacauccccucccggaucucgaucuacuggaccaucgugaagcccggcgacauccugcucaucaacuccaccgggaaccugaucgccccgcgcggcuacuucaagauccggagcggcaaguccucgaucaugcgcuccgacgcccccaucgggaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggcuucaucgagaacgggugggagggcaugguggacgggugguacggcuuccggcaccagaacucggaggggaucggccaggccgcggaccugaaguccacgcaggccgccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccggaacggcaccuacgaccacgacgucuaccgcgacgaggcccucaacaaccgcuuccagaucaagggcguggagcugaaguccggguacaaggacuggauccuguggaucuccuucgccaucagcugcuuccuccugugcguggcccugcucggcuucaucaugugggcgugccagaaggggaacauccggugcaacaucugcaucuga

SEQ ID NO: 8358 - RNA, 1701 nt, Artificial Sequence
  derived and/or modified CDS sequence (AUadapt) from InfluenzaA__AEX36322__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucgaacaacuccuucuucucgcggcugaacuggcucacgcacuccaaguucaaguaccccgcccugaacgugaccaugcccaacaacgaggaguucgacaagcuguacaucuggggcguccaccaccccgggaccgacaacgaccagaucuucccguacgcgcaggccagcggccgcaucaccguguccacgaagaucucgcagcagaccgugauccccaacaucgggagccggccccgcguccggaacauccccucccgcaucucgaucuacuggaccaucgugaagccgggcgacauccuccugaucaacuccaccgggaaccugaucgcgccccggggcuacuucaagauccgcagcggcaaguccucgaucaugcgguccgacgcccccaucgggaagugcaacucggagugcaucacgcccaacggcuccaucccgaacgacaagcccuuccagaacgugaaccgcaucaccuacggggccugcccccgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaucggccaggccgccgaccugaaguccacccaggcggccaucgaccagaucaacggcaagcucaaccggcugaucgggaagaccaacgagaaguuccaccagaucgagaaggaguucucggaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaagggcguggagcucaagucgggguacaaggacuggauccuguggaucuccuucgccaucagcugcuuccugcugugcaucgcccuccugggcuucaucaugugggccugccagaaggggaacauccgcugcaacaucugcaucuga

SEQ ID NO: 8359 - RNA, 1701 nt, Artificial Sequence
  derived and/or modified CDS sequence (AUadapt) from InfluenzaA__AEX36333__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucaacuggaccggcgugacccagaacgggaccucguccgccugcaagcgcggcagcaacaacuccuucuucucgcggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccucgggccgcaucaccguguccacgaagcggagccagcagaccgugaucccgaacaucgggucgcgcccccggguccgcaacauccccucccggaucucgaucuacuggaccaucgugaagcccggcgacauccugcugaucaacuccaccgggaaccucaucgccccgcgcggcuacuucaagauccggagcggcaaguccucgaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacucggaggggaucggccaggccgccgaccucaaguccacccaggcggccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgccuaccgcgacgaggcccugaacaaccgcuuccagaucaagggcgucgagcucaagucgggguacaaggacuggauccuguggaucuccuucgccaucagcugcuuccugcucugcguggcccugcugggcuucaucaugugggcgugccagaaggggaacauccggugcaacaucugcaucuga

SEQ ID NO: 8360 - RNA, 1701 nt, Artificial Sequence
  derived and/or modified CDS sequence (AUadapt) from InfluenzaA__AEX36344__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaacgccuacuccaacugcuaccccuacgacgugccggacuacgcgucgcugcggucccucgucgccagcuccgggacgcuggaguucaacaacgagucguucaacugggccggcgugacccagaacgggaccuccagcgccugcaagcgcggcuccaacaacucguucuucucccggcugaacuggcucacccaccugaaguucaaguaccccgcgcugaacgugacgaugcccaacaacgaggaguucgacaagcucuacaucuggggcguccaccaccccgggaccgacaacgaccagaucuuccuguacgcccaggccagcggccgcaucaccguguccaccaagcggucgcagcagacggugaucccgaacaucgggagccgcccccggguccgcaacauccccucccggaucucgaucuacuggaccaucgugaagcccggcgacauccugcucaucaacuccaccgggaaccugaucgccccgcgcggcuacuucaagauccggagcggcaaguccucgaucaugcgcuccgacgcccccaucgggaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggcuucaucgagaacgggugggagggcaugguggacgggugguacggcuuccggcaccagaacucggaggggaucggccaggccgcggaccugaaguccacgcaggccgccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucgaguccauccggaacgggaccuacgaccacgacgucuaccgcgacgaggcccucaacaaccgcuuccagaucaagggcguggagcugaaguccggcuacaaggacuggauccuguggaucuccuucgccaucagcugcuuccuccugugcguggcccugcucggguucaucaugugggcgugccagaagggcaacauccggugcaacaucugcaucuga

SEQ ID NO: 8361 - RNA, 1701 nt, Artificial Sequence
  derived and/or modified CDS sequence (AUadapt) from InfluenzaA__AEX36366__HA
augaagaccaucaucgcccugucguacauccucugccugguguucgcccagaagcuguccggcaacgacaacagcaccgcgacgcucugccuggggcaccacgccguccccaacggcaccaucgugaagaccaucaccaacgaccagaucgaggugacgaacgccaccgagcugguccaguccucguccaccggggagaucugcgacagcccgcaccagauccucgacggcgagaacugcacccugaucgacgcccugcucggggacccccagugcgacggcuuccagaacaagaagugggaccuguucguggagcgcuccaaggccuacucgaacugcuaccccuacgacgugcccgacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaaguucaaguacccggcccugaacgugaccaugcccaacaacgagaaguucgacaagcucuacaucuggggcguccaccaccccgggaccgacaacgaccagaucuuccuguacgcgcaggccuccgggcggaucaccgugucgacgaagcgcagccagcagaccgugauccccaacaucggcucccggccgcgcguccggaacauccccucgcgcaucuccaucuacuggaccaucgugaagcccggcgacauccugcucaucaacagcaccgggaaccugaucgcgccccggggcuacuucaagauccgcuccggcaagucguccaucaugcggagcgacgccccgaucgggaagugcaacuccgagugcaucacgcccaacggcucgauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 8362 - RNA, 1701 nt, Artificial Sequence; identical to SEQ ID NO: 2173
  derived and/or modified CDS sequence (AUadapt) from InfluenzaA__AEX36377__HA

SEQ ID NO: 8363 - RNA, 1701 nt, Artificial Sequence
  derived and/or modified CDS sequence (AUadapt) from InfluenzaA__AEX36388__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugauggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8364 - RNA, 1701 nt, Artificial Sequence
  derived and/or modified CDS sequence (AUadapt) from InfluenzaA__AEX36399__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagacggaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacccuggaguucaacaacgagucguucaacuggaccggggugacccagaacggcacguccucggccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucacgguguccaccaagcgcagccagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8365 - RNA, 1701 nt, Artificial Sequence
  derived and/or modified CDS sequence (AUadapt) from InfluenzaA__AEX36410__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugucgacgaagcgcucccagcagaccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccggcaagagcuccaucaugcggucggacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 8366 - RNA, 1701 nt, Artificial Sequence; identical to SEQ ID NO: 2679
  derived and/or modified CDS sequence (AUadapt) from InfluenzaA__AEX36421__HA

SEQ ID NO: 8367 - RNA, 1701 nt, Artificial Sequence
  derived and/or modified CDS sequence (AUadapt) from InfluenzaA__AEX36432__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccaggugcucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucuuccuguacgcgcaggccucggggcggaucaccguguccacgaagcgcagccagcagaccgucaucccgaacaucggcucgcggccccgcgugcggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 8368 - RNA, 1701 nt, Artificial Sequence
  derived and/or modified CDS sequence (AUadapt) from InfluenzaA__AEX36443__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8369 - RNA, 1701 nt, Artificial Sequence
  derived and/or modified CDS sequence (AUadapt) from InfluenzaA__AEX36454__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcgugguccugcucggcuucaucaugugggccugccagaaggggaacauccgcugcaacaucugcaucuga

SEQ ID NO: 8370 - RNA, 1701 nt, Artificial Sequence; identical to SEQ ID NO: 1974
  derived and/or modified CDS sequence (AUadapt) from InfluenzaA__AEX36465__HA

SEQ ID NO: 8371 - RNA, 1701 nt, Artificial Sequence
  derived and/or modified CDS sequence (AUadapt) from InfluenzaA__AEX36476__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcggcuccaacaacagcuucuucucccggcugaacuggcucacgcacucgaaguucaaguaccccgcccugaacgugaccaugcccaacaacgaggaguucgacaagcuguacaucuggggcguccaccaccccgggaccgacaacgaccagaucuucccguacgcgcaggccuccggccgcaucaccgugagcacgaagcggucgcagcagaccgugauccccaacaucgggucccgcccccggauccgcaacauccccagccggaucuccaucuacuggaccaucgucaagccgggcgacauccuccugaucaacucgaccgggaaccugaucgcgccccgcggcuacuucaagauccgguccggcaagucguccaucaugcgcagcgacgcccccaucgggaagugcgacuccgagugcaucacgcccaacggcucgaucccgaacgacaagcccuuccagaacgugaaccggaucaccuacggggccugcccccgcuacgugaagcagaacacccucaagcuggccaccggcaugcggaacguccccgagaagcagacgcgcgggaucuucggcgccaucgccggcuucaucgagaacgggugggagggcaugguggacgggugguacggcuuccggcaccagaacuccgaggggaucggccaggccgccgaccugaaguccacccaggcggccaucgaccagaucaacggcaagcucaaccgccugaucgggaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacgacguguaccgcgacgaggcccugaacaaccgcuuccagaucaagggcgucgagcugaaguccggguacaaggacuggauccucuggaucagcuucgccaucuccugcuuccugcugugcguggcccuccugggcuucaucaugugggccugccagaaggggaacauccggugcaacaucugcaucuga

SEQ ID NO: 8372 - RNA, 1701 nt, Artificial Sequence
  derived and/or modified CDS sequence (AUadapt) from InfluenzaA__AEX36487__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgcggcuccaacaacagcuucuucucccggcugaacuggcucacgcacucgaaguucaaguaccccgcccugaacgugaccaugcccaacaacgaggaguucgacaagcuguacaucuggggcguccuccaccccgggaccgacaacgaccagaucuuccuguacgcgcaggccuccggccgcaucaccgugagcacgaagcggucgcagcagaccgugaucccgaacaucgggucccgcccccggguccgcaacauccccagccggaucuccaucuacuggaccaucgugaagcccggcgacauccugcucaucaacucgaccgggaaccugaucgccccgcgcggcuacuucaagauccgguccggcaagagcuccaucaugcgcucggacgcccccaucgggaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccugaaguccacccaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 8373 - RNA, 1701 nt, Artificial Sequence; identical to SEQ ID NO: 8223
  derived and/or modified CDS sequence (AUadapt) from InfluenzaA__AEX36498__HA

SEQ ID NO: 8374 - RNA, 1701 nt, Artificial Sequence
  derived and/or modified CDS sequence (AUadapt) from InfluenzaA__AEX36509__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucaacuggaccggcgugacccagaacgggaccucguccgccugcaagcgcggcagcaacaacuccuucuucucgcggcugaacuggcucacgcacuccaaguucaaguaccccgcccugaacgugaccaugcccaacaacgaggaguucgacaagcuguacaucuggggcguccaccaccccgggaccgacaacgaccagaucuucccguacgcgcaggccucgggccgcaucaccguguccacgaagcggagccagcagaccgugauccccaacaucgggucgcgcccccggguccgcaacauccccucccggaucucgaucuacuggaccaucgugaagccgggcgacauccuccugaucaacuccaccgggaaccugaucgcgccccgcggcuacuucaagauccggagcggcaaguccucgaucaugcgcuccgacgcccccaucgggaagugcaacagcgagugcaucacgcccaacggcuccaucccgaacgacaagcccuuccagaacgugaaccggaucaccuacggggccugcccccgcuacgucaagcagaacacccucaagcuggccaccggcaugcggaacgugcccgagaagcagacgcgcgggaucuucggcgccaucgccggcuucaucgagaacgggugggagggcaugguggacgggugguacggcuuccggcaccagaacucggaggggaucggccaggccgccgaccugaaguccacccaggcggccaucgaccagaucaacggcaagcucaaccgccugaucgggaagaccaacgagaaguuccaccagaucgagaaggaguucucggaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagucgggguacaaggacuggauccuguggaucuccuucgccaucagcugcuuccugcugugcguggcccuccugggcuucaucaugugggccugccagaaggggaacauccggugcaacaucugcaucuga

SEQ ID NO: 8375 - RNA, 1701 nt, Artificial Sequence
  derived and/or modified CDS sequence (AUadapt) from InfluenzaA__AEX36520__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacaacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 8376 - RNA, 1701 nt, Artificial Sequence
  derived and/or modified CDS sequence (AUadapt) from InfluenzaA__AEX36531__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggacaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 8377 - RNA, 1701 nt, Artificial Sequence
  derived and/or modified CDS sequence (AUadapt) from InfluenzaA__AEX36542__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 8378 - RNA, 1701 nt, Artificial Sequence; identical to SEQ ID NO: 8377
  derived and/or modified CDS sequence (AUadapt) from InfluenzaA__AEX36553__HA

SEQ ID NO: 8379 - RNA, 1701 nt, Artificial Sequence; identical to SEQ ID NO: 8377
  derived and/or modified CDS sequence (AUadapt) from InfluenzaA__AEX36564__HA

SEQ ID NO: 8380 - RNA, 1701 nt, Artificial Sequence
  derived and/or modified CDS sequence (AUadapt) from InfluenzaA__AEX36575__HA
augaagaccaucaucgcccugucguacauccucugccugguguucgcccagaagcugcccggcaacgggaacuccaccgcgacgcucugccugggccaccacgccgucccgaacgggaccaucgugaagaccaucaccaacgaccagaucgaggugacgaacgccaccgagcugguccagucguccagcaccggcgagaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucucggaggucgaggggcggauccaggaccuggagaaguacguggaggacaccaagaucgacaucugguccuacaacgccgagcugcucguggcccuggagaaccagcacacgaucgaccugaccgacagcgagaugaacaagcuguucgagaagaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagucgggcuacaaggacuggauccuguggaucuccuucgccaucagcugcuuccugcucugcguggcccugcugggguucaucaugugggccugccagaagggcaacauccggugcaacaucugcaucuga

SEQ ID NO: 8381 - RNA, 1701 nt, Artificial Sequence
  derived and/or modified CDS sequence (AUadapt) from InfluenzaA__AEX36586__HA
augaagaccaucaucgcccugucguacauccucugccugguguucgcccagaagcugcccggcaacgacaacaacaccgcgacgcucugccuggggcaccacgccgucccgaacggcaccaucgugaagaccaucaccaacgaccagaucgaggugacgaacgccaccgagcugguccaguccucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 8382 - RNA, 1701 nt, Artificial Sequence
  derived and/or modified CDS sequence (AUadapt) from InfluenzaA__AEX36597__HA
augaagaccaucaucgcccugucguacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacccuggaguucaacaacgagucguucaacuggacgggggugacccagaacggcaccuccagcgccugcauccgccgguccaacaacucguucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccagcgggcggaucaccguguccaccaagcgcucgcagcagacggugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagguggaccugugguccuacaacgccgagcuccuggucgcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 8383 - RNA, 1701 nt, Artificial Sequence
  derived and/or modified CDS sequence (AUadapt) from InfluenzaA__AEX36608__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagaacuucaacuggaccggcgugacccagaacgggaccagcuccgccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugucgacgaagcgcucccagcagaccgugaucccgaacaucggcucgcggccccgcguccggaacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaagcgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 8384 - RNA, 1701 nt, Artificial Sequence; identical to SEQ ID NO: 8206
  derived and/or modified CDS sequence (AUadapt) from InfluenzaA__AEX36619__HA

SEQ ID NO: 8385 - RNA, 1701 nt, Artificial Sequence
  derived and/or modified CDS sequence (AUadapt) from InfluenzaA__AEX63617__HA
auggaggccaagcuguucguccucuucugcgccuucaccgcgcugaaggccgacaccaucugcgugggcuaccacgccaacaacucgacggacaccguggacaccauccuggagaagaacgugaccgucacgcacuccgugaaccuccuggagaacagccacaacgggaagcugugcucccucaacggcaagaucccccugcagcuggggaacugcaacguggccggcuggauccucgggaacccgaagugcgaccugcugcucaccgccaacucgugguccuacaucaucgagaccagcaacuccaagaacggcgcgugcuaccccggcgaguucgccgacuacgaggagcugaaggagcagcugagcaccgucuccucguucgagcgcuucgagaucuuccccaaggccacguccuggcccaaccacgacaccacccgggggaccacgguggccugcagccacuccggcgcgaacagcuucuaccgcaaccuccuguggaucgugaagaaggggaacuccuacccgaagcugucgaaguccuacaccaacaacaagggcaaggagguccucgugaucuggggcgugcaccacccgcccaccgacagcguccagcagacccuguaccagaacaaccacacguacguguccguggggagcucgaaguacuacaagcgguucacccccgagaucgucgcccgccccaaggugcgggagcaggccggccgcaugaacuacuacuggacccugcucgaccagggggacaccaucacguucgaggccaccggcaaccugaucgcccccuggcacgcguucgcccugaagaagggguccagcuccggcaucaugcggucggacgcccaggugcacaacugcaccaccaagugccagacgccccacggcgcccucaaggggaaccugcccuuccagaacguccacccggugaccaucggcgagugccccaaguacgugaaguccacccagcugcgcauggccaccgggcuccggaacauccccagcauccagucccgcggccuguucggggcgaucgccggcuucaucgagggcggguggacgggcauggucgacgggugguacggcuaccaccaccggaacgagcaggggagcggcuacgccgccgaccagaaguccacccagaucgccaucgacggcaucucgaacaaggugaacuccgugaucgagaagaugaacauccaguucaccagcgucgggaaggaguucaacucccuggagaagcgcauggagaaccucaacaagaagguggacgacggcuuccuggacgucuggaccuacaacgcggagcugcucauccugcuggagaacgagcggacgcucgacuuccacgaccugaacgugaagaaccuguacgagaaggucaagagccagcuccgcaacaacgccaaggagaucgggaacggcugcuucgaguucuaccacaagugcgacaacgagugcauggaguccgugaagaacgggaccuacaacuaccugaaguacucggaggaguccaagcugaaccgggaggagaucgacggcgugaagcucgagagcaugggcauccaccagauccuggccaucuacuccaccguggccagcucgcugguccuccuggugucccugggggccaucagcuucuggaugugcuccaacggcagccuccagugccgcgugugcaucuga

SEQ ID NO: 8386 - RNA, 1698 nt, Artificial Sequence; identical to SEQ ID NO: 3523
  derived and/or modified CDS sequence (AUadapt) from InfluenzaA__AEX92873__HA

SEQ ID NO: 8387 - RNA, 1701 nt, Artificial Sequence; identical to SEQ ID NO: 4078
  derived and/or modified CDS sequence (AUadapt) from InfluenzaA__AEY69088__HA

SEQ ID NO: 8388 - RNA, 1701 nt, Artificial Sequence; identical to SEQ ID NO: 3675
  derived and/or modified CDS sequence (AUadapt) from InfluenzaA__AEY69098__HA

SEQ ID NO: 8389 - RNA, 1701 nt, Artificial Sequence; identical to SEQ ID NO: 3656
  derived and/or modified CDS sequence (AUadapt) from InfluenzaA__AEY69120__HA

SEQ ID NO: 8390 - RNA, 1701 nt, Artificial Sequence; identical to SEQ ID NO: 3858
  derived and/or modified CDS sequence (AUadapt) from InfluenzaA__AEY69131__HA

SEQ ID NO: 8391 - RNA, 1701 nt, Artificial Sequence; identical to SEQ ID NO: 7233
  derived and/or modified CDS sequence (AUadapt) from InfluenzaA__AEY69153__HA

SEQ ID NO: 8392 - RNA, 1701 nt, Artificial Sequence; identical to SEQ ID NO: 3858
  derived and/or modified CDS sequence (AUadapt) from InfluenzaA__AEY69164__HA

SEQ ID NO: 8393 - RNA, 1701 nt, Artificial Sequence; identical to SEQ ID NO: 3858
  derived and/or modified CDS sequence (AUadapt) from InfluenzaA__AEY69175__HA

SEQ ID NO: 8394 - RNA, 1701 nt, Artificial Sequence; identical to SEQ ID NO: 3858
  derived and/or modified CDS sequence (AUadapt) from InfluenzaA__AEY69186__HA

SEQ ID NO: 8395 - RNA, 1701 nt, Artificial Sequence; identical to SEQ ID NO: 3858
  derived and/or modified CDS sequence (AUadapt) from InfluenzaA__AEY69197__HA

SEQ ID NO: 8396 - RNA, 1701 nt, Artificial Sequence; identical to SEQ ID NO: 3858
  derived and/or modified CDS sequence (AUadapt) from InfluenzaA__AEY69208__HA

SEQ ID NO: 8397 - RNA, 1701 nt, Artificial Sequence; identical to SEQ ID NO: 3858
  derived and/or modified CDS sequence (AUadapt) from InfluenzaA__AEY69219__HA

SEQ ID NO: 8398 - RNA, 1701 nt, Artificial Sequence; identical to SEQ ID NO: 3656
  derived and/or modified CDS sequence (AUadapt) from InfluenzaA__AEY69258__HA

SEQ ID NO: 8399 - RNA, 1701 nt, Artificial Sequence; identical to SEQ ID NO: 3858
  derived and/or modified CDS sequence (AUadapt) from InfluenzaA__AEY69269__HA

SEQ ID NO: 8400 - RNA, 1701 nt, Artificial Sequence; identical to SEQ ID NO: 3656
  derived and/or modified CDS sequence (AUadapt) from InfluenzaA__AEY69291__HA

SEQ ID NO: 8401 - RNA, 1701 nt, Artificial Sequence; identical to SEQ ID NO: 3656
  derived and/or modified CDS sequence (AUadapt) from InfluenzaA__AEY69302__HA

SEQ ID NO: 8402 - RNA, 1701 nt, Artificial Sequence; identical to SEQ ID NO: 3656
  derived and/or modified CDS sequence (AUadapt) from InfluenzaA__AEY69313__HA

SEQ ID NO: 8403 - RNA, 1701 nt, Artificial Sequence; identical to SEQ ID NO: 3656
  derived and/or modified CDS sequence (AUadapt) from InfluenzaA__AEY69785__HA

SEQ ID NO: 8404 - RNA, 1701 nt, Artificial Sequence
  derived and/or modified CDS sequence (AUadapt) from InfluenzaA__AEY69807__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggccugcagaacaagaagugggaccuguucguggagcgcuccaaggccuacuccaacugcuaccccuacgacgugccggacuacgcgucgcuccggucccuggucgccagcuccggcacgcuggaguucaacaacgagucguucaacuggaccggggugacccagaacggcaccuccucggccugcauccgccgguccaagaacagcuucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccucggggcggaucaccguguccacgaagcgcucgcagcagaccgccaucccgaacaucggcagccggccccgcgugcggaacauccccucccgcaucucgaucuacuggaccaucgucaagcccggcgacauccuccugaucaacuccaccgggaaccugaucgccccgcggggcuacuucaagcuccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagucgggcuacaaggacuggauccuguggaucuccuucgccaucagcugcuuccugcucugcguggcccugcugggcuucaucaugugggcgugccagaaggggaacauccggugcaacaucugcaucuga

SEQ ID NO: 8405 - RNA, 1701 nt, Artificial Sequence; identical to SEQ ID NO: 3858
  derived and/or modified CDS sequence (AUadapt) from InfluenzaA__AEY69818__HA

SEQ ID NO: 8406 - RNA, 1701 nt, Artificial Sequence; identical to SEQ ID NO: 3858
  derived and/or modified CDS sequence (AUadapt) from InfluenzaA__AEY69829__HA

SEQ ID NO: 8407 - RNA, 1701 nt, Artificial Sequence; identical to SEQ ID NO: 3858
  derived and/or modified CDS sequence (AUadapt) from InfluenzaA__AEY69840__HA

SEQ ID NO: 8408 - RNA, 1701 nt, Artificial Sequence; identical to SEQ ID NO: 3858
  derived and/or modified CDS sequence (AUadapt) from InfluenzaA__AEY69851__HA

SEQ ID NO: 8409 - RNA, 1701 nt, Artificial Sequence; identical to SEQ ID NO: 3858
  derived and/or modified CDS sequence (AUadapt) from InfluenzaA__AEY69873__HA

SEQ ID NO: 8410 - RNA, 1701 nt, Artificial Sequence; identical to SEQ ID NO: 3858
  derived and/or modified CDS sequence (AUadapt) from InfluenzaA__AEY69884__HA

SEQ ID NO: 8411 - RNA, 1701 nt, Artificial Sequence; identical to SEQ ID NO: 3858
  derived and/or modified CDS sequence (AUadapt) from InfluenzaA__AEY69895__HA

SEQ ID NO: 8412 - RNA, 1701 nt, Artificial Sequence; identical to SEQ ID NO: 7233
  derived and/or modified CDS sequence (AUadapt) from InfluenzaA__AEY69906__HA

SEQ ID NO: 8413 - RNA, 1701 nt, Artificial Sequence; identical to SEQ ID NO: 3858
  derived and/or modified CDS sequence (AUadapt) from InfluenzaA__AEY69917__HA

SEQ ID NO: 8414 - RNA, 1701 nt, Artificial Sequence
  derived and/or modified CDS sequence (AUadapt) from InfluenzaA__AEY69939__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucggggcggaucaccguguccacgaagcgcagccagcagaccgccaucccgaacaucggcucgcggccccgcgugcggaacauccccucccgcaucagcaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaacucgggcugcaucacgcccaacggguccauccccaacgacaagccguuccagaacgugaaccgcaucaccuacggcgugugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacagcgagggccgggggcaggccgccgaccucaaguccacccaggcggccaucgaccagaucaacggcaagcugaaccgccugaucggcaagaccaacgagaaguuccaccagaucgagaaggaguucucggaggucgaggggcggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagucgggcuacaaggacugguuccuguggaucuccuucgccaucagcugcuuccugcucugcguggcccugcugggguucaucaugugggccugccagaagggcaacauccggugcaacaucugcaucuga

SEQ ID NO: 8415 - RNA, 1701 nt, Artificial Sequence; identical to SEQ ID NO: 8414
  derived and/or modified CDS sequence (AUadapt) from InfluenzaA__AEY69950__HA

SEQ ID NO: 8416 - RNA, 1701 nt, Artificial Sequence; identical to SEQ ID NO: 8414
  derived and/or modified CDS sequence (AUadapt) from InfluenzaA__AEY69961__HA

SEQ ID NO: 8417 - RNA, 1701 nt, Artificial Sequence
  derived and/or modified CDS sequence (AUadapt) from InfluenzaA__AEY69994__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaagaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcucgcagcagaccgccaucccgaacaucggcagccggccccgcgugcggaacauccccucccgcaucucgaucuacuggaccaucgucaagcccggcgacauccugcugaucaacuccaccgggaaccucaucgccccgcggggcuacuucaagauccgcagcgggaaguccucgaucaugcgguccgacgcccccaucggcaagugcaacucgggcugcaucacgcccaacggguccauccccaacgacaagccguuccagaacgugaaccgcaucaccuacggcgcgugcccccgguacgugaagcagaacacccugaagcuggccaccgggaugcgcaacguccccgagaagcagacgcggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucucggagguggaggggcggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagucgggcuacaaggacugguuccuguggaucuccuucgccaucagcugcuuccugcucugcguggcccugcugggguucaucaugugggcgugccagaagggcaacauccggugcaacaucugcaucuga

SEQ ID NO: 8418 - RNA, 1701 nt, Artificial Sequence; identical to SEQ ID NO: 8417
  derived and/or modified CDS sequence (AUadapt) from InfluenzaA__AEY70005__HA

SEQ ID NO: 8419 - RNA, 1701 nt, Artificial Sequence; identical to SEQ ID NO: 3858
  derived and/or modified CDS sequence (AUadapt) from InfluenzaA__AEY70016__HA

SEQ ID NO: 8420 - RNA, 1701 nt, Artificial Sequence
  derived and/or modified CDS sequence (AUadapt) from InfluenzaA__AEY70256__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacggcaacugcuaccccuacgacgugccggacuacgcgucccugcggagccucgucgccuccucggggacgcuggaguucaacaacgaguccuucaacuggaccggcgugacccagaacgggaccucguccgccugcauccgccggagcaagaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugucgacgaagcgcucccagcagaccgccaucccgaacaucggcagccggccccgcgugcggaacauccccucgcgcaucuccaucuacuggaccaucgucaagcccggggacaugcugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgcgugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggccgggggcaggccgcggaccugaaguccacccaggccgccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacaugggcaacgggugcuucaagaucuaccacaagugcgacaacgccugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 8421 - RNA, 1701 nt, Artificial Sequence; identical to SEQ ID NO: 3858
  derived and/or modified CDS sequence (AUadapt) from InfluenzaA__AEY70267__HA

SEQ ID NO: 8422 - RNA, 1701 nt, Artificial Sequence; identical to SEQ ID NO: 3858
  derived and/or modified CDS sequence (AUadapt) from InfluenzaA__AEY70278__HA

SEQ ID NO: 8423 - RNA, 1701 nt, Artificial Sequence; identical to SEQ ID NO: 3656
  derived and/or modified CDS sequence (AUadapt) from InfluenzaA__AEY70289__HA

SEQ ID NO: 8424 - RNA, 1701 nt, Artificial Sequence; identical to SEQ ID NO: 3858
  derived and/or modified CDS sequence (AUadapt) from InfluenzaA__AEY70300__HA

SEQ ID NO: 8425 - RNA, 1701 nt, Artificial Sequence; identical to SEQ ID NO: 3858
  derived and/or modified CDS sequence (AUadapt) from InfluenzaA__AEY70311__HA

SEQ ID NO: 8426 - RNA, 1701 nt, Artificial Sequence; identical to SEQ ID NO: 3858
  derived and/or modified CDS sequence (AUadapt) from InfluenzaA__AEY70333__HA

SEQ ID NO: 8427 - RNA, 1701 nt, Artificial Sequence; identical to SEQ ID NO: 8417
  derived and/or modified CDS sequence (AUadapt) from InfluenzaA__AEY70344__HA

SEQ ID NO: 8428 - RNA, 1701 nt, Artificial Sequence; identical to SEQ ID NO: 5469
  derived and/or modified CDS sequence (AUadapt) from InfluenzaA__AEY70355__HA

SEQ ID NO: 8429 - RNA, 1701 nt, Artificial Sequence; identical to SEQ ID NO: 3656
  derived and/or modified CDS sequence (AUadapt) from InfluenzaA__AEY70365__HA

SEQ ID NO: 8430 - RNA, 1701 nt, Artificial Sequence; identical to SEQ ID NO: 3858
  derived and/or modified CDS sequence (AUadapt) from InfluenzaA__AEY70376__HA

SEQ ID NO: 8431 - RNA, 1701 nt, Artificial Sequence
  derived and/or modified CDS sequence (AUadapt) from InfluenzaA__AFB18656__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccagcuucgagcgcuucgagaucuuccccaagaccuccucguggcccaaccacgacuccaacaagggcgucaccgccgccugcccgcacgccggcgcgaagggguucuacaagaaccugaucuggcucgugaagaagggcaacucguaccccaagcuguccaagagcuacaucaacgacaaggggaaggaggugcugguccucuggggcauccaccaccccuccacgaccgccgaccagcagucgcuguaccagaacgccgacaccuacguguucgugggcaccucgcgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgucccgucgauccagucccggggccuguucggggcgaucgccggcuucaucgagggcggguggaccggcaugguggacgggugguacggcuaccaccaccagaacgagcaggggucgggcuacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagucgacccgcaucuaccagauccuggccaucuacuccaccgcggccagcucccugguccucguggugucgcugggcgccaucuccuucuggaugugcucgaacggcagccugcagugccggaucugcaucuga

SEQ ID NO: 8432 - RNA, 1701 nt, Artificial Sequence; identical to SEQ ID NO: 7295
  derived and/or modified CDS sequence (AUadapt) from InfluenzaA__AFB40597__HA

SEQ ID NO: 8433 - RNA, 1701 nt, Artificial Sequence; identical to SEQ ID NO: 7295
  derived and/or modified CDS sequence (AUadapt) from InfluenzaA__AFB40598__HA

SEQ ID NO: 8434 - RNA, 1701 nt, Artificial Sequence
  derived and/or modified CDS sequence (AUadapt) from InfluenzaA__AFB40599__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgaccugaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 8435 - RNA, 1701 nt, Artificial Sequence; identical to SEQ ID NO: 4078
  derived and/or modified CDS sequence (AUadapt) from InfluenzaA__AFB40600__HA

SEQ ID NO: 8436 - RNA, 1701 nt, Artificial Sequence
  derived and/or modified CDS sequence (AUadapt) from InfluenzaA__AFB40601__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccgagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 8437 - RNA, 1701 nt, Artificial Sequence; identical to SEQ ID NO: 116
  derived and/or modified CDS sequence (AUadapt) from InfluenzaA__AFB40602__HA

SEQ ID NO: 8438 - RNA, 1701 nt, Artificial Sequence; identical to SEQ ID NO: 4078
  derived and/or modified CDS sequence (AUadapt) from InfluenzaA__AFB40603__HA

SEQ ID NO: 8439 - RNA, 1701 nt, Artificial Sequence
  derived and/or modified CDS sequence (AUadapt) from InfluenzaA__AFB40604__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaaggaggggaacucguaccccaagcuguccaagagcuacaucaacgacaagggcaaggaggugcugguccucugggggauccaccacccgcccaccacggccgaccagcagucgcuguaccagaacgccgacaccuacguguucgugggcaccucccgguacagcaagaaguucaagcccgagaucgccauccgccccaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucucggacaccccggugcacgacugcaacaccacgugccagacccccaagggcgccaucaacaccucccugcccuuccagaacauccaccccaucaccaucgggaagugcccgaaguacgucaagucgacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcgguggacaaggaguucaaccaccuggagaagcgcaucggcaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 8440 - RNA, 1701 nt, Artificial Sequence; identical to SEQ ID NO: 116
  derived and/or modified CDS sequence (AUadapt) from InfluenzaA__AFB70138__HA

SEQ ID NO: 8441 - RNA, 1701 nt, Artificial Sequence
  derived and/or modified CDS sequence (AUadapt) from InfluenzaA__AFB70145__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaaggggaucaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 8442 - RNA, 1701 nt, Artificial Sequence
  derived and/or modified CDS sequence (AUadapt) from InfluenzaA__AFB70154__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacgggacgugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 8443 - RNA, 1701 nt, Artificial Sequence; identical to SEQ ID NO: 116
  derived and/or modified CDS sequence (AUadapt) from InfluenzaA__AFB70156__HA

SEQ ID NO: 8444 - RNA, 1701 nt, Artificial Sequence; identical to SEQ ID NO: 116
  derived and/or modified CDS sequence (AUadapt) from InfluenzaA__AFB70158__HA

SEQ ID NO: 8445 - RNA, 1701 nt, Artificial Sequence; identical to SEQ ID NO: 8441
  derived and/or modified CDS sequence (AUadapt) from InfluenzaA__AFB70160__HA

SEQ ID NO: 8446 - RNA, 1701 nt, Artificial Sequence; identical to SEQ ID NO: 4108
  derived and/or modified CDS sequence (AUadapt) from InfluenzaA__AFB70162__HA

SEQ ID NO: 8447 - RNA, 1701 nt, Artificial Sequence
  derived and/or modified CDS sequence (AUadapt) from InfluenzaA__AFB70167__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccaugcgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 8448 - RNA, 1701 nt, Artificial Sequence; identical to SEQ ID NO: 116
  derived and/or modified CDS sequence (AUadapt) from InfluenzaA__AFB70177__HA

SEQ ID NO: 8449 - RNA, 1701 nt, Artificial Sequence; identical to SEQ ID NO: 3483
  derived and/or modified CDS sequence (AUadapt) from InfluenzaA__AFB70187__HA

SEQ ID NO: 8450 - RNA, 1701 nt, Artificial Sequence; identical to SEQ ID NO: 4108
  derived and/or modified CDS sequence (AUadapt) from InfluenzaA__AFB70197__HA

SEQ ID NO: 8451 - RNA, 1701 nt, Artificial Sequence; identical to SEQ ID NO: 116
  derived and/or modified CDS sequence (AUadapt) from InfluenzaA__AFB70207__HA

SEQ ID NO: 8452 - RNA, 1701 nt, Artificial Sequence; identical to SEQ ID NO: 116
  derived and/or modified CDS sequence (AUadapt) from InfluenzaA__AFB70217__HA

SEQ ID NO: 8453 - RNA, 1701 nt, Artificial Sequence; identical to SEQ ID NO: 116
  derived and/or modified CDS sequence (AUadapt) from InfluenzaA__AFB70227__HA

SEQ ID NO: 8454 - RNA, 1701 nt, Artificial Sequence
  derived and/or modified CDS sequence (AUadapt) from InfluenzaA__AFB70247__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaaggaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 8455 - RNA, 1701 nt, Artificial Sequence
  derived and/or modified CDS sequence (AUadapt) from InfluenzaA__AFB70257__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucguggacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 8456 - RNA, 1701 nt, Artificial Sequence; identical to SEQ ID NO: 7321
  derived and/or modified CDS sequence (AUadapt) from InfluenzaA__AFB70267__HA

SEQ ID NO: 8457 - RNA, 1701 nt, Artificial Sequence; identical to SEQ ID NO: 3384
  derived and/or modified CDS sequence (AUadapt) from InfluenzaA__AFB70277__HA

SEQ ID NO: 8458 - RNA, 1701 nt, Artificial Sequence; identical to SEQ ID NO: 116
  derived and/or modified CDS sequence (AUadapt) from InfluenzaA__AFB70287__HA

SEQ ID NO: 8459 - RNA, 1701 nt, Artificial Sequence; identical to SEQ ID NO: 116
  derived and/or modified CDS sequence (AUadapt) from InfluenzaA__AFB70297__HA

SEQ ID NO: 8460 - RNA, 1701 nt, Artificial Sequence; identical to SEQ ID NO: 116
  derived and/or modified CDS sequence (AUadapt) from InfluenzaA__AFB70307__HA

SEQ ID NO: 8461 - RNA, 1701 nt, Artificial Sequence; identical to SEQ ID NO: 8441
  derived and/or modified CDS sequence (AUadapt) from InfluenzaA__AFB70317__HA

SEQ ID NO: 8462 - RNA, 1701 nt, Artificial Sequence
  derived and/or modified CDS sequence (AUadapt) from InfluenzaA__AFB70327__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccugggcaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 8463 - RNA, 1701 nt, Artificial Sequence; identical to SEQ ID NO: 116
  derived and/or modified CDS sequence (AUadapt) from InfluenzaA__AFB70337__HA

SEQ ID NO: 8464 - RNA, 1701 nt, Artificial Sequence; identical to SEQ ID NO: 4884
  derived and/or modified CDS sequence (AUadapt) from InfluenzaA__AFB70347__HA

SEQ ID NO: 8465 - RNA, 1701 nt, Artificial Sequence; identical to SEQ ID NO: 116
  derived and/or modified CDS sequence (AUadapt) from InfluenzaA__AFB70367__HA

SEQ ID NO: 8466 - RNA, 1701 nt, Artificial Sequence; identical to SEQ ID NO: 116
  derived and/or modified CDS sequence (AUadapt) from InfluenzaA__AFB70377__HA

SEQ ID NO: 8467 - RNA, 1701 nt, Artificial Sequence; identical to SEQ ID NO: 3483
  derived and/or modified CDS sequence (AUadapt) from InfluenzaA__AFB70387__HA

SEQ ID NO: 8468 - RNA, 1701 nt, Artificial Sequence; identical to SEQ ID NO: 116
  derived and/or modified CDS sequence (AUadapt) from InfluenzaA__AFB70397__HA

SEQ ID NO: 8469 - RNA, 1701 nt, Artificial Sequence; identical to SEQ ID NO: 116
  derived and/or modified CDS sequence (AUadapt) from InfluenzaA__AFB70407__HA

SEQ ID NO: 8470 - RNA, 1701 nt, Artificial Sequence
  derived and/or modified CDS sequence (AUadapt) from InfluenzaA__AFB77618__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccucguccgacaacggcacgugcuaccccggcgacuucaucaacuacgaggagcuccgggagcagcugagcuccgugucguccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagucguacaucaacgacaagggcaaggaggugcuggugcucugggggauccaccaccccaccacgaccggcgaccagcagagccuguaccagaacgccgacggcuacgucuucguggggaccacccgguacuccaagaaguucaagcccgagaucggcauccgcccgaaggugaaggaccaggaggggcggaugaacuacuacuggacgcuggucgagcccggcgacaagaucaccuucgaggccaccggcaaccucguggugccccgcuacgccuucgccauggagcggaacgcggggucgggcaucaucaucuccgacacccccguccacgacugcaacacgaccugccagaccccgaagggggccaucaacaccucgcugcccuuccagaacauccaccccaucacgaucggcaagugccccaaguacgugaaguccaccaagcugcgccucgccaccgggcugcggaacgugccgagcauccagucccgcggccuguucggcgccaucgccggguucaucgagggcggguggaccggcauggucgacgggugguacggcuaccaccaccagaacgagcagggcucgggguacgcggccgaccucaaguccacgcagaacgccaucgacaagaucaccaacaaggugaacucggugaucgagaagaugaacacccaguucaccgccgucggcaaggaguucaaccaccuggagaagcggaucgagaaccugaacaagaagguggacgacggguuccucgacaucuggacguacaacgccgagcugcugguccuccuggagaacgagcgcacccuggacuaccacgacuccaacgugaagaaccucuacgagaaggugcggaaccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgcgaggagaucgacggcgugaagcucgagucgacccggaucuaccagauccuggccaucuacuccaccguggccucgucccuggucaugguggugagccucggggccaucuccuucuggaugugcucgaacggcagccugcagugccgcaucugcaucuga

SEQ ID NO: 8471 - RNA, 1701 nt, Artificial Sequence; identical to SEQ ID NO: 7112
  derived and/or modified CDS sequence (AUadapt) from InfluenzaA__AFB77619__HA

SEQ ID NO: 8472 - RNA, 1701 nt, Artificial Sequence; identical to SEQ ID NO: 7112
  derived and/or modified CDS sequence (AUadapt) from InfluenzaA__AFB77620__HA

SEQ ID NO: 8473 - RNA, 1701 nt, Artificial Sequence
  derived and/or modified CDS sequence (AUadapt) from InfluenzaA__AFB77621__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgcggccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacaucccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 8474 - RNA, 1701 nt, Artificial Sequence
  derived and/or modified CDS sequence (AUadapt) from InfluenzaA__AFB77622__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugucgaaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacaccccggugcacgacugcaacacgaccugccagacccccaagggcgccaucaacaccucccugcccuuccagaacauccaccccaucaccaucgggaagugcccgaaguacgucaagucgaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacucgaccgucgccuccagccuggugcucguggucucccugggggccaucucguucuggaugugcagcaacggcucccugcagugccggaucugcaucuga

SEQ ID NO: 8475 - RNA, 1701 nt, Artificial Sequence; identical to SEQ ID NO: 7112
  derived and/or modified CDS sequence (AUadapt) from InfluenzaA__AFB77623__HA

SEQ ID NO: 8476 - RNA, 1701 nt, Artificial Sequence; identical to SEQ ID NO: 7112
  derived and/or modified CDS sequence (AUadapt) from InfluenzaA__AFB77624__HA

SEQ ID NO: 8477 - RNA, 1701 nt, Artificial Sequence
  derived and/or modified CDS sequence (AUadapt) from InfluenzaA__AFB77625__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 8478 - RNA, 1701 nt, Artificial Sequence
  derived and/or modified CDS sequence (AUadapt) from InfluenzaA__AFB77627__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucaacuacgaggagcuccgggagcagcugucguccgugagcuccuucgagcgcuucgagaucuucucgaagaccuccagcuggcccaaccacgacuccaacaagggggucaccgccgccugcccccacgccggcgccaagucguucuacaagaaccugaucuggcucgugaagaaggggaacuccuacccgaagcugagcaagucguacaucaacgacaagggcaaggaggugcugguccucugggggauccaccaccccuccaccacggccgaccagcagucgcuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucgccauggagcgcaacgccggguccggcaucaucaucucggacacccccgugcacgacugcaacacgaccugccagacccccaagggcgccaucaacaccucccugccguuccagaacauccaccccaucaccaucgggaagugccccaaguacgucaagagcaccaagcugcggcucgcgacgggccugcgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 8479 - RNA, 1701 nt, Artificial Sequence; identical to SEQ ID NO: 7112
  derived and/or modified CDS sequence (AUadapt) from InfluenzaA__AFB77628__HA

SEQ ID NO: 8480 - RNA, 1701 nt, Artificial Sequence
  derived and/or modified CDS sequence (AUadapt) from InfluenzaA__AFB77629__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgaggagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 8481 - RNA, 1701 nt, Artificial Sequence
  derived and/or modified CDS sequence (AUadapt) from InfluenzaA__AFB77630__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgagucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 8482 - RNA, 1701 nt, Artificial Sequence
  derived and/or modified CDS sequence (AUadapt) from InfluenzaA__AFB77631__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaccaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 8483 - RNA, 1701 nt, Artificial Sequence
  derived and/or modified CDS sequence (AUadapt) from InfluenzaA__AFB77632__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcugaccaccgcguccagcugguccuacaucguggagacgucguccucggacaacgggaccugcuaccccggcgacuucaucaacuacgaggagcuccgggagcagcuguccagcguguccucguucgagcgcuucgagaucuuccccaagaccuccagcuggcccaaccacgacuccaacaagggcgucaccgccgccugcccgcacgccggcgccaagucguucuacaagaaccugaucuggcucgugaagaaggggaacuccuaccccaagcugucgaaguccuacaucaacgacaagggcaaggaggugcugguccucugggggauccaccaccccagcacgaccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucgccauggagcgcaacgccggguccggcaucaucaucucggacacccccgugcacgacugcaacaccacgugccagaccccgaagggcgccaucaacaccucccugcccuuccagaacauccaccccaucaccaucgggaagugccccaaguacgucaagucgacgaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacucgaccgucgccuccagccuggugcucguggucucccugggggccaucucguucuggaugugcagcaacggcucccugcagugcaagaucugcaucuga

SEQ ID NO: 8484 - RNA, 1701 nt, Artificial Sequence
  derived and/or modified CDS sequence (AUadapt) from InfluenzaA__AFB77633__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcucccacgccggcgccaagucguucuacaagaaccugaucuggcucgugaagaaggggaacuccuacccgaagcugagcaagucguacaucaacgacaagggcaaggaggugcugguccucugggggauccaccaccccuccaccacggccgaccagcagucgcuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucgccauggagcgcaacgccggguccggcaucaucaucucggacacccccgugcacgacugcaacacgaccugccagacccccaagggcgccaucaacaccucccugccguuccagaacauccaccccaucaccaucgggaagugccccaaguacgucaagagcaccaagcugcggcucgcgacgggccugcgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagaaccagcugaagaacaacgccaaggagaucgggaacggcugcuucgaguucuaccacaagugcgacaacacgccgaucaagaacgugaagaacgggaccuacgacuaccccaaguacuccgaggaggccaagcugaaccgcgaggagaucgacggcgugaagcucgagucgacccggaucuaccagauccuggcgaucuacuccaccgucgccucgucccuggugcucguggucagccugggggccaucucguucuggaugugcuccaacggcagccugcagugccgcaucugcaucuga

SEQ ID NO: 8485 - RNA, 1701 nt, Artificial Sequence
  derived and/or modified CDS sequence (AUadapt) from InfluenzaA__AFB77634__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggagaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 8486 - RNA, 1701 nt, Artificial Sequence
  derived and/or modified CDS sequence (AUadapt) from InfluenzaA__AFB77635__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagccccugguccuacaucguggagaccucguccucggacaacggcacgugcuaccccggcgacuucaucaacuacgaggagcuccgggagcagcuguccagcguguccucguucgagcgcuucgagaucuuccccaagaccuccagcuggccgaaccacgacuccaacaagggggucaccgccgccugcccccacgccggcgccaagucguucuacaagaaccugaucuggcucgugaagaaggggaacuccuaccccaagcugucgaaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacaccccggugcacgacugcaacacgaccugccagacccccaagggcgccaucaacaccucccugcccuuccagaacauccaccccaucaccaucgggaagugcccgaaguacgucaagucgaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacucgaccgucgccuccagccuggugcucguggucucccugggggccaucucguucuggaugugcagcaacggcucccugcagugccggaucugcaucuga

SEQ ID NO: 8487 - RNA, 1701 nt, Artificial Sequence
  derived and/or modified CDS sequence (AUadapt) from InfluenzaA__AFB77636__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaaggccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugaugguggucagccucggggccaucucguucuggaugugcuccaacggcagccugcagugccggaucugcaucuga

SEQ ID NO: 8488 - RNA, 1701 nt, Artificial Sequence
  derived and/or modified CDS sequence (AUadapt) from InfluenzaA__AFB77637__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagggccgggaccaggaggggcgcaugaacuacuacuggacccuggucgagcccggcgacaagaucaccuucgaggcgacggggaaccucguggugccccgguacgccuucgccauggagcgcaacgccggcagcggcaucaucaucuccgacacccccguccacgacugcaacacgaccugccagaccccgaagggggccaucaacaccucgcugcccuuccagaacauccaccccaucaccaucggcaagugccccaaguacgugaaguccaccaagcugcggcucgcgacggggcugcgcaacgugccgagcauccagucccggggccuguucggggccaucgccggcuucaucgagggcggguggaccggcauggucgacgggugguacggcuaccaccaccagaacgagcaggggucgggcuacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagucgacccgcaucuaccagauccuggcgaucuacuccaccguggccucgucccugguccucguggugagccugggcgccaucucguucuggaugugcuccaacggcagccugcagugccggaucugcaucuga

SEQ ID NO: 8489 - RNA, 1701 nt, Artificial Sequence
  derived and/or modified CDS sequence (AUadapt) from InfluenzaA__AFB77638__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaaguucuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucccugggggccaucucguucuggaugugcagcaacggcucccugcagugccggaucugcaucuga

SEQ ID NO: 8490 - RNA, 1701 nt, Artificial Sequence; identical to SEQ ID NO: 7112
  derived and/or modified CDS sequence (AUadapt) from InfluenzaA__AFB77639__HA

SEQ ID NO: 8491 - RNA, 1701 nt, Artificial Sequence
  derived and/or modified CDS sequence (AUadapt) from InfluenzaA__AFB77640__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagggccuguaccagaacgccgacgccuacguguucgugggcaccucccgguacagcaagaaguucaagcccgagaucgccauccgcccgaagguccgggaccaggaggggcgcaugaacuacuacuggacccugguggagcccggcgacaagaucaccuucgaggcgacggggaaccucguggucccccgguacgccuucgccauggagcgcaacgccggcuccggcaucaucaucucggacacccccgugcacgacugcaacacgaccugccagaccccgaagggggccaucaacaccucccugcccuuccagaacauccaccccaucaccaucggcaagugccccaaguacgucaagucgaccaagcugcggcucgcgacggggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacucgaccgucgccuccagccuggugcucguggucucccugggcgccaucucguucuggaugugcagcaacggcucccugcagugccggaucugcaucuga

SEQ ID NO: 8492 - RNA, 1701 nt, Artificial Sequence
  derived and/or modified CDS sequence (AUadapt) from InfluenzaA__AFB77641__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacaugugcauggagucggugaagaacgggacguacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 8493 - RNA, 1701 nt, Artificial Sequence; identical to SEQ ID NO: 7112
  derived and/or modified CDS sequence (AUadapt) from InfluenzaA__AFB77642__HA

SEQ ID NO: 8494 - RNA, 1701 nt, Artificial Sequence
  derived and/or modified CDS sequence (AUadapt) from InfluenzaA__AFB77643__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagcccucguccuggccgaaccacgacagcaacaagggggucaccgccgccugcccccacgccggcgcgaaguccuucuacaagaaccugaucuggcucgugaagaaggggaacucguaccccaagcuguccaagucguacaucaacgacaagggcaaggaggugcugguccucugggggauccaccaccccagcaccaccgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacgacaccaaggacuccgaggaggccaagcugaaccgggaggagaucgacggcgugaagcucgagucgacccgcaucuaccagauccuggcgaucuacuccaccgucgccagcucccuggugcucguggucucgcugggggccaucucguucuggaugugcuccaacggcagccugcagugccggaucugcaucuga

SEQ ID NO: 8495 - RNA, 1701 nt, Artificial Sequence
  derived and/or modified CDS sequence (AUadapt) from InfluenzaA__AFB77691__HA
augaagaccaucaucgcccugucguacauccucugccugguguucgcccagaagcugcccggcaacgacaacuccaccgcgacccucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaacaacuccuucuucagccgccugaacuggcucacgcaccugaacuucaaguaccccgcccugaacgugaccaugcccaacaacgagcaguucgagaagcucuacaucuggggcguccaccaccccgggaccgacaaggaccagaucuuccuguacgcgcaggccuccgggcggaucaccgugucgacgaagcgcucccagcaggccgugaucccgaacaucggcucgcggcugcgcguccggaacauccccagccgcaucuccaucuacuggaccaucgugaagcccggcgacauccuccugaucaacucgaccgggaaccugaacgcgccccggggcuacuucaagauccgcuccggcaagucguccaucaugcggagcgacgccccgaucgggaagugcaacuccgagugcaucacccccaacggcucgauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagaagaccaagaaccagcuccgcgagaacgcggaggacauggggaacggcugcuucaagaucuaccacaagugcgacaacacgugcaucgggucgauccgcaacggcaccuacgaccacgacgccuaccgggacgaggcccugaacaaccgcuuccagaucaagggggucgagcugaaguccggcuacaaggacuggauccucuggaucagcuucgccaucuccugcuuccugcugugcguggcccuccugggcuucaucaugugggcgugccagaaggggaacauccggugcaacaucugcaucuga

SEQ ID NO: 8496 - RNA, 1701 nt, Artificial Sequence
  derived and/or modified CDS sequence (AUadapt) from InfluenzaA__AFB77692__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcucccagcaggccgugaucccgaacaccggcucgcggccccgcguccggaacauccccagccgcaucuccaucuacuggaccaucgugaagcccggcgacauccugcucaucaacucgaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggcgugcccccgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgcggaccucaagucgacccaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 8497 - RNA, 1701 nt, Artificial Sequence; identical to SEQ ID NO: 8027
  derived and/or modified CDS sequence (AUadapt) from InfluenzaA__AFB77693__HA

SEQ ID NO: 8498 - RNA, 1701 nt, Artificial Sequence
  derived and/or modified CDS sequence (AUadapt) from InfluenzaA__AFB77694__HA
augaagaccaucaucgcccugucguacauccucugccugguguucgcccagaagcugcccggcaacgacaacuccaccgcgacccucugccuggggcaccacgccgucccgaacggcaccaucgugaagaccaucgccaacgaccagaucgaggugaccaacgccacggagcugguccagaacucguccaccggggagaucugcgacagcccccaccagauccucgacggcgagaacugcacccugaucgacgcccugcucggggacccccagugcgacgacuuccagaacaagaagugggaccuguucguggagcgcuccaaggcguacucgaacugcuaccccuacgacgugccggacuacgccucccugcggagccucgucgccuccucgggcacccuggaguucaacaacgaguccuucaacuggacgggcgugacccagaacgggaccucguccgccugcauccgccggagcaacaacuccuucuucucgcgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccggccggaucaccgugagcaccaagcgcucccagcaggccgugaucccgaacaucgggucgcggccccgcguccggaacauccccucgcgcaucuccaucuacuggacgaucgugaagcccggcgacauccugcucaucaacagcaccggcaaccugaucgccccgcggggguacuucaagauccgcuccggcaagucguccaucaugcggagcgacgcgcccaucgggaagugcaacuccgagugcaucacccccaacggcucgauccccaacgacaagccguuccagaacgugaaccgcaucaccuacggcgccugcccccgguacgucaagcagaacacgcugaagcucgccaccgggaugcgcaacgugcccgagaagcagacccggggcaucuucggggccaucgccggcuucaucgagaacgggugggagggcaugguggacggcugguacggguuccgccaccagaacuccgagggccgggggcaggcggccgaccucaagucgacccaggccgccaucgaccagaucaacggcaagcugaaccgccugaucgggaagacgaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacacgugcaucggcucgauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggcgugccagaagggcaacauccggugcaacaucugcaucuga

SEQ ID NO: 8499 - RNA, 1701 nt, Artificial Sequence
  derived and/or modified CDS sequence (AUadapt) from InfluenzaA__AFB77695__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacgacuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggcgugacccagaacgggaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucccagcaggccgugaucccgaacaucgggucgcggccccgcguccggaacauccccucgcgcaucuccaucuacuggaccaucgugaagcccggcgacauccugcucaucaacagcaccggcaaccugaucgccccgcggggguacuucaagauccgcuccggcaagucguccaucaugcggagcgacgcccccaucgggaagugcaacuccgagugcaucacccccaacggcucgauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacgggugggagggcaugguggacggcugguacggguuccgccaccagaacuccgagggccgggggcaggccgcggaccucaagucgacgcaggccgccaucgaccagaucaacggcaagcugaaccgccugaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacaugggcaacgggugcuucaagaucuaccacaagugcgacaacgccugcaucggcucgauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggcgugccagaagggcaacauccggugcaacaucugcaucuga

SEQ ID NO: 8500 - RNA, 1701 nt, Artificial Sequence
  derived and/or modified CDS sequence (AUadapt) from InfluenzaA__AFB78126__HA
augaagaccaucaucgcccugucguacauccucugccugguguucgcccagaagcugcccggcaacgacaacuccaccgcgacgcucugccuggggcaccacgccgucucgaacggcacccuggugaagaccaucaccaacgaccagaucgaggugacgaacgccaccgagcucguccaguccagcuccaccgggcgcaucugcgacucgccgcaccagauccuggacggcgagaacugcacccugaucgacgcccuccugggggacccccacugcgacggcuuccagaacaaggagugggaccuguucguggagcgguccaaggccuacagcaacugcuaccccuacgacgugcccgacuacgcgucccuccgcucgcuggucgccuccagcggcacgcuggaguucaacaacgaguccuucaacuggaccgggguggcccaggacggcaccucguccgccugcaagcggcgcagcaacaaguccuucuucucgcggcucaacuggcugcaccagcugaaguacaaguacccggcgcucaacgugaccaugcccaacaacgagaaguucgacaagcuguacaucuggggcguccaccaccccuccacggacagcgaccagaucucgaucuacgcccaggccuccgggcgcgugaccgugucgaccaagcggucccagcagaccgucauccccaacaucgggagcuccccgugggugcgcggcgccucgucccggaucagcaucuacuggacgaucgugaagcccggcgacauccugcucaucaacuccaccgggaaccugaucgcgccccgcggcuacuucaagauccggucggggaaguccagcaucaugcgcuccgacgcccccaucggcaagugcaacucggagugcaucaccccgaacggcuccauccccaacgacaagcccuuccagaacgucaaccggaucaccuacggggccugcccccgcuacgugaagcagaacacgcugaagcucgccaccggcaugcggaacgugccggagaagcagacccgcgggaucuucggcgccaucgccggguucaucgagaacggcugggagggcauggucgacgggugguacggcuuccggcaccagaacagcgaggggaccggccaggcggccgaccugaaguccacgcaggccgccaccaaccagaucaacgggaagcugaaccgccucaucgagaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagcgcaccaagaagcagcugcgggagaacgccgaggacaugggcaacgggugcuucaagaucuaccacaagugcgacaacgccugcaucggcucgauccgcaacgggaccuacgaccacgacguguaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggcgugccagaagggcaacauccgcugcaacaucugcaucuga

SEQ ID NO: 8501 - RNA, 1701 nt, Artificial Sequence
  derived and/or modified CDS sequence (AUadapt) from InfluenzaA__AFC34056__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagcgcacccugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccggaacggcaccuacaaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8502 - RNA, 1701 nt, Artificial Sequence; identical to SEQ ID NO: 8501
  derived and/or modified CDS sequence (AUadapt) from InfluenzaA__AFC34057__HA

SEQ ID NO: 8503 - RNA, 1701 nt, Artificial Sequence
  derived and/or modified CDS sequence (AUadapt) from InfluenzaA__AFD32426__HA
augaaggccaaccugcucgugcugcugucggcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugcaagcugcgcggcguggcgccccuccaccuggggaagugcaacaucgccggccggauccuggggaacccggagugcgagucgcucuccacggccagcuccuggucguacaucgucgagacccccuccagcgacaacgggaccugcuaccccggcgacuucaucgacuacgaggagcugcgcgagcagcuguccucgguguccagcuucgagcgguucgagaucuuccccaagaccuccucguggccgaaccacgacuccaacaagggggugacggccgcgugcccccacgccggcgccaagagcuucuacaagaaccucaucuggcuggucaagaaggggaacuccuaccccaagcugucgaagagcuacaucaacgacaagggcaaggaggugcucgugcugugggggauccaccaccccuccaccucggccgaccagcagucccuguaccagaacgccgacaccuacgucuucgugggcagcucccgcuacucgaagaaguucaagccggagaucgcgauccggcccaaggugcgcgaccaggagggccggaugaacuacuacuggacccucgucgagcccggggacaagaucacguucgaggccaccggcaaccugguggugccccgcuacgccuucgccauggagcggaacgccggguccggcaucaucaucagcgacaccccgguccacgacugcaacaccaagugccagacgccccugggcgcgaucaacuccucgcuccccuaccagaacauccaccccgugaccaucggggagugcccgaaguacgugcgcuccgccaagcugcggauggucaccggccugcgcaacacccccagcauccagucccggggccucuucggcgccaucgccggguucaucgagggcggcuggacggggaugaucgacggcugguacggguaccaccaccagaacgagcagggcucgggguacgccgcggaccagaaguccacccagaacgccaucaacggcaucaccaacaaggugaacaccgugaucgagaagaugaacauccaguucacggccgucggcaaggaguucaacaagcuggagaagcgcauggagaaccugaacaagaagguggacgacggguuccucgacaucuggaccuacaacgccgagcugcugguccuccuggagaacgagcggacccuggacuuccacgacagcaacgugaagaaccucuacgagaaggugaagucccagcugaagaacaacgccaaggagaucggcaacgggugcuucgaguucuaccacaagugcgacaacgagugcauggagucgguccgcaacggcaccuacgacuaccccaaguacuccgaggagagcaagcugaaccgggagaagguggacggggugaagcucgagucgaugggcaucuaccagauccuggcgaucuacuccacggucgccagcucccuggugcuccuggugucgcugggcgccaucuccuucuggaugugcagcaacgggucccuccagugccgcaucugcaucuga

SEQ ID NO: 8504 - RNA, 1698 nt, Artificial Sequence
  derived and/or modified CDS sequence (AUadapt) from InfluenzaA__AFD32427__HA
augaaggccaaccugcucgugcugcugucggcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugcgaccuggacggcgugaagccccucauccugcgcgacugcucggucgcgggguggcugcucggcaacccgaugugcgacgaguucaucaacgugcccgagugguccuacaucguggagaaggccaaccccgucaacgaccugugcuaccccggggacuucaacgacuacgaggagcugaagcaccuccugagccggaucaaccacuucgagaagauccagaucaucccgaaguccagcugguccucgcacgaggccucccugggcgugagcuccgccugccccuaccagggcaagagcuccuucuuccgcaacguggucuggcucaucaagaagaacucgacguaccccaccaucaagcgguccuacaacaacaccaaccaggaggaccugcuggugcucugggggauccaccaccccaacgacgcggccgagcagaccaagcuguaccagaacccgacgaccuacaucagcgugggcaccuccacccugaaccagcgccucgucccccggaucgccacgcgcucgaaggugaacgggcagagcggccggauggaguucuucuggaccauccugaagcccaacgacgccaucaacuucgaguccaacgggaacuucaucgcccccgaguacgcguacaagaucgugaagaagggcgacagcaccaucaugaaguccgagcuggaguacggcaacugcaacaccaagugccagacgccgcucggggccaucaacucgucccugcccuaccagaacauccaccccgucaccaucggcgagugccccaaguacgugcgcagcgccaagcugcggauggugaccgggcuccgcaacaccccguccauccagagccggggccuguucggcgccaucgccggguucaucgagggcggguggacgggcaugaucgacgggugguacggcuaccaccaccagaacgagcagggcuccggguacgcggccgaccagaaguccacccagaacgccaucaacggcaucaccaacaaggucaacaccgugaucgagaagaugaacauccaguucacggccguggggaaggaguucaacaagcuggagaagcgcauggagaaccucaacaagaaggucgacgacggcuuccuggacaucuggaccuacaacgccgagcugcucgugcugcuggagaacgagcggacccucgacuuccacgacucgaacgucaagaaccuguacgagaaggucaagagccagcugaagaacaacgcgaaggagaucgggaacggcugcuucgaguucuaccacaagugcgacaacgagugcauggaguccgugcgcaacggcaccuacgacuaccccaaguacucggaggaguccaagcucaaccgggagaagguggacggggugaagcuggagagcaugggcaucuaccagauccuggccaucuacuccacgguggccagcucccucguccugcuggugucgcucggggccaucagcuucuggaugugcuccaacggcagccugcagugccgcaucugcaucuga

SEQ ID NO: 8505 - RNA, 1722 nt, Artificial Sequence
  derived and/or modified CDS sequence (AUadapt) from InfluenzaA__AFD32428__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgaccucgacggcgugaagccccugauccugcgcgacugcuccguggccggguggcuccugggcaaccccaugugcgacgaguucaucaacguccccgaguggagcuacaucguggagaaggccaacccggugaacgaccugugcuaccccggcgacuucaacgacuacgaggagcucaagcaccuccugucccggaucaaccacuucgagaagauccagaucauccccaagagcuccuggucgucccacgaggcgagccucggggucuccagcgccugccccuaccagggcaaguccucguucuuccgcaacgugguguggcugaucaagaagaacuccaccuacccgacgaucaagcggagcuacaacaacaccaaccaggaggaccugcucguccugugggggauccaccaccccaacgacgccgccgagcagaccaagcuguaccagaaccccaccacguacaucuccgugggcaccucgacccucaaccagcgccuggugccccggaucgcgacccgcagcaaggucaacgggcaguccggccggauggaguucuucuggacgauccugaagccgaacgacgccaucaacuucgagagcaacggcaacuucaucgcccccgaguacgccuacaagaucgugaagaagggggacuccaccaucaugaaguccgagcucgaguacggcaacugcaacucggagugcaucacccccaacgggagcauccccaacgacaagccguuccagaacgugaaccgcaucaccuacggcgccugcccccgguacgucaagcagaacacgcugaagcuggcgaccggcaugcgcaacgugcccgagaagcagacccgggggaucuucggcgccaucgccggguucaucgagaacggcugggaggggaugguggacggcugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgaggucgaggggcggauccaggaccucgagaaguacguggaggacaccaagaucgaccuguggucguacaacgccgagcugcucguggcccuggagaaccagcacaccaucgaccugaccgacuccgagaugaacaagcuguucgagaagacgaagaagcagcugcgcgagaacgccgaggacaugggcaacggcugcuucaagaucuaccacaagugcgacaacgcgugcaucgggagcauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcgucgcccugcugggguucaucaugugggccugccagaagggcaacauccgcugcaacaucugcaucuga

SEQ ID NO: 8506 - RNA, 1704 nt, Artificial Sequence
  derived and/or modified CDS sequence (AUadapt) from InfluenzaA__AFD32429__HA
augaagaccaucaucgcccugaguuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaguuccucgaccggggagaucugcacccagggcaagcgccccacggaccucgggcagugcggccugcugggcacccucaucgggccgccccagugcgaccaguuccuggaguucgacgccgaccugaucaucgagcggcgcgagggcaccgacgugugcuaccccgggaaguuuaccaacgaggagucccuccggcagauccugcgcggcagcgggggcaucgacaaggaguccaugggcuucacguacagcgggauccggaccaacggcgccaccuccgcgugccgccggucgggguccagcuucuacgccgagaugaaguggcugcucuccaacucggauaacgccgaguucccccagaugaccaaguccuaccgcaacccccggaacaagcccgcccugaucaucuggggcgugcaccacagcggcuccgcgacggagcagaccaagcuguacgggagcggcaacaagcucaucaccgucggguccucgaaguaccagcagaguuucaccccgucccccggcgcccgcccccaggugaacgggcagucgggccggaucgacuuccacuggcugcugcucgaccccaacgacacggugaccuucaccuucaacggcgccuucaucgccccggaucgcgccuccuucuuccgcggggagagccugggcguccaguccgacgugccccuggacagcgggugcaacuccgagugcaucacccccaacggcucgauccccaacgacaagccguuccagaaugugaaccggaucacguacggggcgugcccccgguacgucaagcagaacacccucaagcuggccaccggcaugcgcaacgugcccgagaagcagacccggggcaucuucggggccaucgccggcuucaucgagaacgggugggagggcaugguggacgggugguacggcuuccgccaccagaauuccgagggccgggggcaggccgcggaccucaagagcacgcaggccgccaucgaccagaucaacggcaagcugaaccgccugaucgggaagaccaacgagaaguuccaccagaucgagaaggaguucuccgaggucgagggccggauccaggaccuggagaaguacguggaggacaccaagaucgaccucuggaguuacaacgccgagcugcugguggcccucgagaaccagcacaccaucgaccugacggacuccgagaugaacaagcuguucgagaagaccaagaagcagcuccgcgagaacgcggaggacaugggcaacgggugcuucaagaucuaccauaagugcgacaacgccugcaucggcagcauccgcaacgggaccuacgaccacgacgucuaccgggacgaggcccugaacaaucgcuuccagaucaagggcguggagcugaaguccggguacaaggacuggauccucuggaucagcuucgccaucuccugcuuccugcugugcguggcccuccugggcuucaucaugugggcgugccagaagggcaacauccggugcaacaucugcaucuga

SEQ ID NO: 8507 - RNA, 1701 nt, Artificial Sequence; identical to SEQ ID NO: 318
  derived and/or modified CDS sequence (AUadapt) from InfluenzaA__AFD63527__HA

SEQ ID NO: 8508 - RNA, 1701 nt, Artificial Sequence
  derived and/or modified CDS sequence (AUadapt) from InfluenzaA__AFD63538__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcgguccaucgucgccucguccgggacgcucgaguucaacaacgagucguucaacuggaccggcgugacccagaacgggaccuccagcgccugcaagcgcaaguccaacaagucguucuucucccggcugaacuggcugacgcaccucaaguacaaguaccccgcccugaacgugaccaugcccaacaacgagaaguucgacaagcuguacaucuggggcguccaccaccccgggaccgacaacgaccagaucucgcucuacgcgcaggccuccggccgcaucaccgugagcacgaagcggucgcagcagaccgugaucccgaacaucggcucccgcccccggguccgcgacgugucgucccggaucucgaucuacuggaccaucgugaagcccggggacauccugcugaucaacuccaccggcaaccucaucgcgccccgcggguacuucaagauccggagcggcaaguccucgaucaugcgcuccgacgccccgaucggcaagugcaacucggagugcaucacgcccaacggguccauccccaacgacaagcccuuccagaacgucaaccggaucaccuacggcgccugcccgcgcuacgugaagcagaacacccugaagcuggccaccgggaugcggaacgugcccgagaagcagacgcgcggcaucuucggggccaucgccggcuucaucgagaacggcugggaggggauggucgacggcugguacggguuccggcaccagaacucggagggcaccgggcaggccgccgaccucaaguccacccaggcggccaucaaccagaucaacggcaagcugaaccgccugaucggcaagaccaacgagaaguuccaccagaucgagaaggaguucagcgagguggaggggcggauccaggaccucgagaaguacguggaggacacgaagaucgaccugugguccuacaacgccgagcugcucgucgcccuggagaaccagcacaccaucgaccugaccgacucggagaugaacaagcuguucgagcgcaccaagaagcagcuccgggagaacgccgaggacaugggcaacgggugcuucaagaucuaccacaagugcgacaacgcgugcaucggcuccauccgcaacgggacguacgaccacgacguguaccgcgacgaggcccugaacaaccgguaccagaucaagggcguggagcucaagucgggcuacaaggacuggauccuguggaucuccuucgccaucagcugcuuccugcucugcgucgcccugcugggguucaucaugugggccugccagaagggcaacauccgcugcaacaucugcaucuga

SEQ ID NO: 8509 - RNA, 1701 nt, Artificial Sequence
  derived and/or modified CDS sequence (AUadapt) from InfluenzaA__AFD63549__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacaacgaccagaucucccuguacgcgcaggccucgggccggaucaccguguccacgaagcgcucgcagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 8510 - RNA, 1701 nt, Artificial Sequence; identical to SEQ ID NO: 318
  derived and/or modified CDS sequence (AUadapt) from InfluenzaA__AFD63571__HA

SEQ ID NO: 8511 - RNA, 1701 nt, Artificial Sequence
  derived and/or modified CDS sequence (AUadapt) from InfluenzaA__AFD63615__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucucgcuguacgcgcaggccuccggccgcaucaccgugucgacgaagcggagccagcagaccgugaucccgaacaucggcucccgcccccggguccgcgacgugucgucccggaucucgaucuacuggaccaucgugaagcccggggacauccugcucaucaacuccaccggcaaccugaucgcgccccgcggguacuucaagauccggagcggcaaguccucgaucaugcgcuccgacgccccgaucggcaagugcaacucggagugcaucacgcccaacggguccauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucucggagguggaggagcggauccaggaccuggagaaguacguggaggacacgaagaucgaccugugguccuacaacgccgagcuccuggucgcccuggagaaccagcacaccaucgaccucaccgacucggagaugaacaagcuguucgagcgcaccaagaagcagcugcgggagaacgccgaggacauggggaacggcugcuucaagaucuaccacaagugcgacaacgcgugcaucggguccauccgcaacggcacguacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 8512 - RNA, 1701 nt, Artificial Sequence
  derived and/or modified CDS sequence (AUadapt) from InfluenzaA__AFD63626__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacaucucgucccgcaucagcaucuacuggaccaucgugaagcccggggacauccugcucaucaacuccaccggcaaccugaucgcgccccggggguacuucaagauccgcucgggcaaguccucgaucaugcgguccgacgccccgaucggcaagugcaacagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcucaagucgggcuacaaggacuggauccuguggaucuccuucgccaucagcugcuuccugcugugcguggcccugcucggguucaucaugugggccugccagaagggcaacauccggugcaacaucugcaucuga

SEQ ID NO: 8513 - RNA, 1701 nt, Artificial Sequence
  derived and/or modified CDS sequence (AUadapt) from InfluenzaA__AFD63637__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccacgugcaagcgccggucgaacaaguccuucuucagccgccugaacuggcucacccaccugaaguacaaguaccccgcccugaacgugaccaugcccaacaacgagaaguucgacaagcucuacaucuggggcguccaccaccccgggaccgacuccgaccagaucucgcuguacgcccaggcguccggccggaucacggugagcaccaagcgcucgcagcagaccgugaucccgaacaucggcucccggccccgcguccgggacgugucgucccgcaucagcaucuacuggaccaucgugaagcccggggacauccugcucaucaacuccacgggcaaccugaucgcgccccggggguacuucaagauccgcucgggcaaguccucgaucaugcgguccgacgccccgaucggcaagugcaacagcgagugcaucacccccaacggguccauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacucggagggcaccgggcaggccgccgaccugaaguccacccaggccgcgaucaaccagaucaacggcaagcugaaccggcucaucggcaagacgaacgagaaguuccaccagaucgagaaggaguucucggagguggaggggcgcauccaggaccuggagaaguacguggaggacaccaagaucgaccugugguccuacaacgccgagcuccuggucgcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgccugcaucggcuccauccgcaacgggaccuacgaccacgacguguaccgggacgaggcgcucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 8514 - RNA, 1701 nt, Artificial Sequence
  derived and/or modified CDS sequence (AUadapt) from InfluenzaA__AFD63648__HA
augaagaccaucaucgcccugucguacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacccuggaguucaacaacgaguccuucgacuggacgggcgugacccagaacgggaccucguccgccugcaagcgccggagcaacaaguccuucuucucgcgccugaacuggcucacccaccugaaguacaaguaccccgcccugaacgugacgaugcccaacaacgagaaguucgacaagcucuacaucuggggcguccaccaccccgggaccgacuccgaccagaucagccuguacgcgcaggccuccggccggaucaccgugucgaccaagcgcucgcagcagacggugaucccgaacaucggcucccggccccgcguccgggacgugagcucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacccccaacggguccauccccaacgacaagcccuuccagaacgucaaccgcaucacguacggcgccugcccgcgguacgugaagcagaacacccugaagcucgccaccgggaugcgcaacgugcccgagaagcagacccggggcaucuucggggccaucgccggcuucaucgagaacggcugggaggggauggucgacggcugguacggguuccgccaccagaacagcgagggcacggggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 8515 - RNA, 1701 nt, Artificial Sequence; identical to SEQ ID NO: 318
  derived and/or modified CDS sequence (AUadapt) from InfluenzaA__AFD63659__HA

SEQ ID NO: 8516 - RNA, 1701 nt, Artificial Sequence
  derived and/or modified CDS sequence (AUadapt) from InfluenzaA__AFD63681__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucucgcuguacgcgcaggccuccggccgcaucaccgugucgacgaagcggagccagcagaccgugaucccgaacaucggcucccgcccccggguccgcgacgugucgucccggaucucgaucuacuggaccaucgugaagcccggggacauccugcucaucaacuccaccggcaaccugaucgcgccccgcggguacuucaagguccggagcggcaaguccucgaucaugcgcuccgacgccccgaucggcaagugcaacucggagugcaucacgcccaacggguccauccccaacgacaagcccuuccagaacgugaaccggaucaccuacggcgccugcccgcgcuacgugaagcagaacacccugaagcucgccaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 8517 - RNA, 1701 nt, Artificial Sequence
  derived and/or modified CDS sequence (AUadapt) from InfluenzaA__AFD63692__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucgacuggaccggcgugacccagaacgggaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcguccugcaccccgggaccgacagcgaccagaucucccuguacgcgcaggccucgggccggaucaccgugagcacgaagcgcucccagcagaccgugaucccgaacaucggcucgcggccccgcguccgggacguguccucgcgcaucuccaucuacuggaccaucgugaagcccggggacauccuccugaucaacagcaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccucaagcuggccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcucaaccggcugaucggcaagaccaacgagaaguuccaccagaucgagaaggaguucuccgagguggaggggcgcauccaggaccuggagaaguacguggaggacacgaagaucgaccucuggucguacaacgccgagcugcuggucgcccucgagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcguggagcugaaguccggcuacaaggacuggauccucuggaucucguucgccaucagcugcuuccugcugugcgucgcccuccugggguucaucaugugggccugccagaagggcaacauccggugcaacaucugcaucuga

SEQ ID NO: 8518 - RNA, 1701 nt, Artificial Sequence
  derived and/or modified CDS sequence (AUadapt) from InfluenzaA__AFD63703__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccagcgggaucugcgacucccccuaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucgacuggaccggggugacccagaacggcaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccucggggcggaucaccgugagcacgaagcgcucccagcagaccgugaucccgaacaucggcucgcggccccgcguccgggacguguccagccagaucuccaucuacuggaccaucgugaagcccggcgacauccugcucaucaacucgaccgggaaccugaucgcgccccgcggcuacuucaagauccgguccggcaagucguccaucaugcgcagcgacgccccgaucgggaagugcaacuccgagugcaucacgcccaacggcucgauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacuccgaggggaccggccaggccgccgaccucaagagcacccaggcggccaucaaccagaucaacgggaagcugaaccgccugaucggcaagaccaacgagaaguuccaccagaucgagaaggaguucuccgagguggagggccggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgggagaacgccgaggacauggggaacggcugcuucaagaucuaccacaagugcgacaacgcgugcaucgggagcauccgcaacggcacguacgaccacgacguguaccgcgacgaggcccucaacaaccgguuccagaucaaggggguggagcugaaguccggcuacaaggacuggauccuguggaucucguucgccaucagcugcuuccuccugugcgucgcccugcucggcuucaucaugugggccugccagaaggggaacauccgcugcaacaucugcaucuga

SEQ ID NO: 8519 - RNA, 1701 nt, Artificial Sequence
  derived and/or modified CDS sequence (AUadapt) from InfluenzaA__AFD63714__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccacgugcaagcgccggucgaacaaguccuucuucagccgccugaacuggcucacccaccugaaguacaaguaccccgcccugaacgugaccaugcccaacaacgagaaguucgacaagcucuacaucuggggcguccaccaccccgggaccgacaacgaccagaucucccuguacgcccaggcgucgggccggaucacgguguccaccaagcgcucgcagcagaccgugaucccgaacaucggcagccggccccgcguccgggacguguccucgcgcaucuccaucuacuggaccaucgugaagcccggggacauccugcucaucaacucgacgggcaaccugaucgcgccccggggguacuucaagauccgcuccggcaagagcuccaucaugcggucggacgccccgaucggcaagugcaacuccgagugcaucacccccaacgggucgauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccucaagagcacccaggccgcgaucaaccagaucaacggcaagcugaaccggcugaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcagaccaucgaccucaccgacuccgagaugaacaagcuguucgagcggacgaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccacaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 8520 - RNA, 1701 nt, Artificial Sequence
  derived and/or modified CDS sequence (AUadapt) from InfluenzaA__AFD63736__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccacgugcaagcgccggucgaacaaguccuucuucagccgccugaacuggcucacccaccugaaguacaaguaccccgcccugaacgugaccaugcccaacaacgagaaguucgacaagcucuacaucuggggcguccaccaccccgggaccgacaacgaccagaucucccuguacgcccaggcgucgggccggaucacgguguccaccaagcgcucgcagcagaccgugaucccgaacaucggcagccggccccgcguccgggacguguccucgcgcaucuccaucuacuggaccaucgugaagcccggggacauccugcucaucaacucgacgggcaaccugaucgcgccccggggguacuucaagauccgcuccggcaagagcuccaucaugcggucggacgccccgaucggcaagugcaacuccgagugcaucacccccaacgggucgauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccucaagagcacccaggccgcgaucaaccagaucaacggcaagcugaaccggcugaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccacaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 8521 - RNA, 1701 nt, Artificial Sequence
  derived and/or modified CDS sequence (AUadapt) from InfluenzaA__AFD63747__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccgcaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggccugccagaagggcaacauccgcugcaacaucugcaucuga

SEQ ID NO: 8522 - RNA, 1701 nt, Artificial Sequence
  derived and/or modified CDS sequence (AUadapt) from InfluenzaA__AFD63758__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucucgcuguacgcgcaggccuccggccgcaucaccgugucgacgaagcggagccagcagaccgugaucccgaacaucggcucccgcccccggguccgcgacgugucgucccggaucucgaucuacuggaccaucgugaagcccggggacauccugcucaucaacuccaccggcaaccugaucgcgccccgcggguacuucaagauccggagcggcaaguccucgaucaugcgcuccgacgccccgaucggcaagugcaacucggagugcaucacgcccaacggguccauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucucggagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 8523 - RNA, 1701 nt, Artificial Sequence
  derived and/or modified CDS sequence (AUadapt) from InfluenzaA__AFD63769__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacaacgaccagaucucccuguacgcgcaggccucgggccggaucaccguguccacgaagcgcagccagcagaccgugaucccgaacaucggcucgcggccccgcguccgggacguguccucgcgcaucuccaucuacuggaccaucgugaagcccggggacauccugcucaucaacagcaccggcaaccugaucgcgccccggggguacuucaagauccgcuccggcaagucguccaucaugcggucggacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagucgacccaggcggccaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccacaucaaguccguggagcucaagucgggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 8524 - RNA, 1701 nt, Artificial Sequence; identical to SEQ ID NO: 318
  derived and/or modified CDS sequence (AUadapt) from InfluenzaA__AFD63780__HA

SEQ ID NO: 8525 - RNA, 1701 nt, Artificial Sequence; identical to SEQ ID NO: 8522
  derived and/or modified CDS sequence (AUadapt) from InfluenzaA__AFD63791__HA

SEQ ID NO: 8526 - RNA, 1701 nt, Artificial Sequence; identical to SEQ ID NO: 318
  derived and/or modified CDS sequence (AUadapt) from InfluenzaA__AFD63802__HA

SEQ ID NO: 8527 - RNA, 1701 nt, Artificial Sequence
  derived and/or modified CDS sequence (AUadapt) from InfluenzaA__AFD63813__HA
augaagaccaucaucgcccugucguacauccucucccugguguucgcccagaaguuccccggcaacgacaacucgaccgcgacgcugugccucgggcaccacgccgucccgaacggcaccaucgugaagaccaucaccaacgaccagaucgaggugacgaacgccaccgagcugguccagaucuccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccuggucgccagcuccgggucgcucgaguucaacaacgaguccuucgacuggacgggcgugacccagaacgggaccagcuccgccugcaagcgccggucgaacaaguccuucuucucgcgccugaacuggcugacccaccucaaguacaaguaccccgcccugaacgugacgaugcccaacaacgagaaguucgacaagcuguacaucuggggcguccaccaccccgggaccgacuccgaccagaucagccucuacgcgcaggccucgggccggaucaccguguccaccaagcgcagccagcagacggugaucccgaacaucggcucccggccccgcguccgggacaucucgucccgcaucucgaucuacuggaccaucgugaagcccggggacauccugcugaucaacuccaccggcaaccucaucgcgccccggggguacuucaagauccgcagcggcaaguccucgaucaugcgguccgacgccccgaucggcaagugcaacagcgagugcaucacccccaacggguccauccccaacgacaagcccuuccagaacgugaaccgcaucacguacggcgccugcccgcgguacgucaagcagaacacccugaagcuggccaccgggaugcgcaacgugcccgagaagcagacccggggcaucuucggggccaucgccggcuucaucgagaacggcugggaggggaugguggacggcugguacggguuccgccaccagaacucggagggcacggggcaggccgccgaccucaaguccacccaggcggccaucaaccagaucaacggcaagcugaaccggcugaucggcaagaccaacgagaaguuccaccagaucgagaaggaguucucggaggucgaggggcgcauccaggaccucgagaaguacguggaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagucgggcuacaaggacuggauccuguggaucagcuucgccacguccugcuuccugcucugcguggcccugcugggguucaucaugugggccugccagaagggcaacauccggugcaacaucugcaucuga

SEQ ID NO: 8528 - RNA, 1701 nt, Artificial Sequence; identical to SEQ ID NO: 8512
  derived and/or modified CDS sequence (AUadapt) from InfluenzaA__AFD63824__HA

SEQ ID NO: 8529 - RNA, 1701 nt, Artificial Sequence; identical to SEQ ID NO: 318
  derived and/or modified CDS sequence (AUadapt) from InfluenzaA__AFD63846__HA

SEQ ID NO: 8530 - RNA, 1701 nt, Artificial Sequence; identical to SEQ ID NO: 1556
  derived and/or modified CDS sequence (AUadapt) from InfluenzaA__AFD63857__HA

SEQ ID NO: 8531 - RNA, 1701 nt, Artificial Sequence; identical to SEQ ID NO: 318
  derived and/or modified CDS sequence (AUadapt) from InfluenzaA__AFD63868__HA

SEQ ID NO: 8532 - RNA, 1701 nt, Artificial Sequence; identical to SEQ ID NO: 318
  derived and/or modified CDS sequence (AUadapt) from InfluenzaA__AFD63890__HA

SEQ ID NO: 8533 - RNA, 1701 nt, Artificial Sequence; identical to SEQ ID NO: 318
  derived and/or modified CDS sequence (AUadapt) from InfluenzaA__AFD63901__HA

SEQ ID NO: 8534 - RNA, 1701 nt, Artificial Sequence; identical to SEQ ID NO: 318
  derived and/or modified CDS sequence (AUadapt) from InfluenzaA__AFD63912__HA

SEQ ID NO: 8535 - RNA, 1701 nt, Artificial Sequence
  derived and/or modified CDS sequence (AUadapt) from InfluenzaA__AFD63923__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucucgcuguacgcgcaggccuccggccgcaucaccgugucgacgaagcggagccagcagaccgugaucccgaacaucggcucccgcccccggguccgcgacaucucgucccggaucucgaucuacuggaccaucgugaagcccggggacauccugcucaucaacuccaccggcaaccugaucgcgccccgcggguacuucaagauccggagcggcaaguccucgaucaugcgcuccgacgccccgaucggcaagugcaacucggagugcaucacgcccaacggguccauccccaacgacaagcccuuccagaacgugaaccggaucaccuacggcgccugcccgcgcuacgucaagcagaacacccugaagcucgccaccgggaugcggaacgugcccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucucggaggucgaggggcggauccaggaccuggagaaguacguggaggacacgaagaucgaccugugguccuacaacgccgagcuccugguggcccuggagaaccagcacaccaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 8536 - RNA, 1701 nt, Artificial Sequence
  derived and/or modified CDS sequence (AUadapt) from InfluenzaA__AFD63934__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgagucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccguggucaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 8537 - RNA, 1701 nt, Artificial Sequence; identical to SEQ ID NO: 8512
  derived and/or modified CDS sequence (AUadapt) from InfluenzaA__AFD63945__HA

SEQ ID NO: 8538 - RNA, 1701 nt, Artificial Sequence; identical to SEQ ID NO: 8512
  derived and/or modified CDS sequence (AUadapt) from InfluenzaA__AFD63956__HA

SEQ ID NO: 8539 - RNA, 1701 nt, Artificial Sequence; identical to SEQ ID NO: 8512
  derived and/or modified CDS sequence (AUadapt) from InfluenzaA__AFD63967__HA

SEQ ID NO: 8540 - RNA, 1701 nt, Artificial Sequence; identical to SEQ ID NO: 318
  derived and/or modified CDS sequence (AUadapt) from InfluenzaA__AFD63989__HA

SEQ ID NO: 8541 - RNA, 1701 nt, Artificial Sequence; identical to SEQ ID NO: 318
  derived and/or modified CDS sequence (AUadapt) from InfluenzaA__AFD64000__HA

SEQ ID NO: 8542 - RNA, 1701 nt, Artificial Sequence
  derived and/or modified CDS sequence (AUadapt) from InfluenzaA__AFD64011__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccccgggcaagaucaccgugucgacgaagcggagccagcagaccgugauccccaacaucggcucccgcccccggguccgcgacgugucgucccggaucucgaucuacuggaccaucgugaagcccggggacauccugcucaucaacuccaccggcaaccugaucgccccgcgcggguacuucaagauccggagcggcaaguccucgaucaugcgcuccgacgcccccaucggcaagugcaacucggagugcaucacgcccaacggguccauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucucggagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcgacaucugcaucuga

SEQ ID NO: 8543 - RNA, 1701 nt, Artificial Sequence; identical to SEQ ID NO: 318
  derived and/or modified CDS sequence (AUadapt) from InfluenzaA__AFD64022__HA

SEQ ID NO: 8544 - RNA, 1701 nt, Artificial Sequence; identical to SEQ ID NO: 318
  derived and/or modified CDS sequence (AUadapt) from InfluenzaA__AFD64033__HA

SEQ ID NO: 8545 - RNA, 1701 nt, Artificial Sequence
  derived and/or modified CDS sequence (AUadapt) from InfluenzaA__AFD64044__HA
augaagaccaucaucgcccugucguacauccucugccugguguucgcccagaagcugcccggcaacgagaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 8546 - RNA, 1701 nt, Artificial Sequence; identical to SEQ ID NO: 8522
  derived and/or modified CDS sequence (AUadapt) from InfluenzaA__AFD64055__HA

SEQ ID NO: 8547 - RNA, 1701 nt, Artificial Sequence
  derived and/or modified CDS sequence (AUadapt) from InfluenzaA__AFD64066__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacacgucgcugcggucccucgucgcgagcuccgggacccuggaguucaacaacgagucguucaacuggaccggcgugacccagaacgggacguccucggccugcaagcgccgguccaacaagucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcccaggcguccggccggaucacggugucgaccaagcgcucgcagcagaccgugaucccgaacaucggcucccggccccgcguccgggacgugcccagccgcaucuccaucuacuggaccaucgugaagcccggggacauccugcucaucaacucgacgggcaaccugaucgccccgcggggguacuucaagauccgcuccggcaagucguccaucaugcggucggacgcccccaucggcaagugcaacuccgagugcaucacccccaacgggagcauccccaacgacaagccguuccagaacgucaaccgcaucaccuacggcgccugcccccgguacgugaagcagaacacccugaagcucgccacggggaugcgcaacgugcccgagaagcagacccggggcaucuucggggcgaucgccggcuucaucgagaacggcugggaggggauggucgacggcugguacggguuccgccaccagaacgccgagggcaccgggcaggccgccgaccugaaguccacccaggcggccaucaaccagaucaacggcaagcugaaccggcucaucggcaagacgaacgagaaguuccaccagaucgagaaggaguucucggagguggaggggcgcauccaggaccuggagaaguacguggaggacaccaagaucgaccugugguccuacaacgccgagcuccuggucgcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaagaacuggauccuguggaucuccuucgccaucagcugcuuccuccugugcgucgcccugcucggguucaucaugugggccugccagaagggcaacauccggugcaacaucugcaucuga

SEQ ID NO: 8548 - RNA, 1701 nt, Artificial Sequence
  derived and/or modified CDS sequence (AUadapt) from InfluenzaA__AFD64077__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucgacuggaccggggugacccagaacggcaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccgggcggaucaccgugagcacgaagcgcucgcagcagaccgugaucccgaacaucggcucccggccccgcauccgggacgucucgucccgcaucagcaucuacuggaccaucgugaagcccggcgacauccugcucaucaacuccaccgggaaccugaucgcgccccggggcuacuucaagauccgcucggggaaguccucgaucaugcgguccgacgccccgaucggcaagugcaacagcgagugcaucacgcccaacggcuccauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacucggaggggaccggccaggccgccgaccugaaguccacccaggcggccaucaaccagaucaacgggaagcugaaccggcucaucggcaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaaggggguggagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 8549 - RNA, 1701 nt, Artificial Sequence; identical to SEQ ID NO: 318
  derived and/or modified CDS sequence (AUadapt) from InfluenzaA__AFD64088__HA

SEQ ID NO: 8550 - RNA, 1701 nt, Artificial Sequence; identical to SEQ ID NO: 318
  derived and/or modified CDS sequence (AUadapt) from InfluenzaA__AFD64099__HA

SEQ ID NO: 8551 - RNA, 1701 nt, Artificial Sequence; identical to SEQ ID NO: 8522
  derived and/or modified CDS sequence (AUadapt) from InfluenzaA__AFD64110__HA

SEQ ID NO: 8552 - RNA, 1701 nt, Artificial Sequence
  derived and/or modified CDS sequence (AUadapt) from InfluenzaA__AFD64121__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgcgggccuacuccaacugcuaccccuacgacgugccggacuacgcgucgcugcgcucccucgucgccagcuccgggacgcuggaguucaacaacgagucguucaacuggaccggcgugacccagaacgggaccuccucggccugcaagcggaaguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacaacgaccagaucucgcuguacgcgcaggccuccggccggaucaccgugucgacgaagcgcagccagcagaccgugaucccgaacaucggcucccggccccgcguccgggacgugucgucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 8553 - RNA, 1701 nt, Artificial Sequence; identical to SEQ ID NO: 318
  derived and/or modified CDS sequence (AUadapt) from InfluenzaA__AFD64132__HA

SEQ ID NO: 8554 - RNA, 1701 nt, Artificial Sequence; identical to SEQ ID NO: 8512
  derived and/or modified CDS sequence (AUadapt) from InfluenzaA__AFD64143__HA

SEQ ID NO: 8555 - RNA, 1701 nt, Artificial Sequence; identical to SEQ ID NO: 318
  derived and/or modified CDS sequence (AUadapt) from InfluenzaA__AFD64154__HA

SEQ ID NO: 8556 - RNA, 1701 nt, Artificial Sequence
  derived and/or modified CDS sequence (AUadapt) from InfluenzaA__AFD64179__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccagaucagcaucuacuggaccaucgugaagcccggggacauccugcucaucaacuccaccggcaaccugaucgcgccccgcggguacuucaagauccggucgggcaaguccucgaucaugcgcuccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacucggagggcaccgggcaggccgccgaccugaaguccacccaggcggccaucaaccagaucaacggcaagcugaaccgccucaucggcaagaccaacgagaaguuccaccagaucgagaaggaguucucggagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcguggagcucaagucgggcuacaaggacuggauccuguggaucuccuucgccaucagcugcuuccugcugugcgucgcccugcucggguucaucaugugggccugccagaagggcaacauccgcugcaacaucugcaucuga

SEQ ID NO: 8557 - RNA, 1701 nt, Artificial Sequence; identical to SEQ ID NO: 8556
  derived and/or modified CDS sequence (AUadapt) from InfluenzaA__AFD64190__HA

SEQ ID NO: 8558 - RNA, 1701 nt, Artificial Sequence; identical to SEQ ID NO: 8512
  derived and/or modified CDS sequence (AUadapt) from InfluenzaA__AFD64201__HA

SEQ ID NO: 8559 - RNA, 1701 nt, Artificial Sequence; identical to SEQ ID NO: 8522
  derived and/or modified CDS sequence (AUadapt) from InfluenzaA__AFD64212__HA

SEQ ID NO: 8560 - RNA, 1701 nt, Artificial Sequence
  derived and/or modified CDS sequence (AUadapt) from InfluenzaA__AFD64223__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagagcuucaacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccugcaccccgggaccgacucggaccagauccggcuguacgcgcaggccuccggccgcaucaccgugucgacgaagcggagccagcagaccgugaucccgaacaucggcucccgcccccggguccgcgacgugucgucccggaucagcaucuacuggaccaucgugaagcccggggacauccuccugaucaacuccaccggcaaccugaucgcgccccgcggguacuucaagauccggucgggcaaguccucgaucaugcgcuccgacgccccgaucggcaagugcaacagcgagugcaucacgcccaacggguccauccccaacgacaagcccuuccagaacgucaaccggaucaccuacggcgccugcccgcgcuacaucaagcagaacacccucaagcuggccaccgggaugcggaacgugcccgagaagcagacgcgcggcaucuucggggccaucgccggcuucaucgagaacggcugggaggggaugguggacggcugguacggguuccggcaccagaacucggagggcaccgggcaggccgccgaccugaaguccacccaggcggccaucaaccagaucaacggcaagcucaaccgccugaucggcaagaccaacgagaaguuccaccagaucgagaaggaguucagcgaggucgaggggcggauccaggaccuggagaaguacguggaggacacgaagaucgaccucugguccuacaacgccgagcugcugguggcccucgagaaccaguacaccaucgaccugaccgacucggagaugaacaagcuguucgagcgcaccaagaagcagcuccgcgagaacgccgaggacaugggcaacgggugcuucaagaucuaccacaagugcgacaacgcgugcaucggcuccauccggaacgggacguacgaccacgacgucuaccgcgacgaggcccugaacaaccgguuccagaucaagggcguggagcugaaguccggcuacaaggacuggauccucuggaucuccuucgccaucagcugcuuccugcugugcguggcccuccugggguucaucaugugggccugccagaagggcaacauccgcugcaacaucugcaucuga

SEQ ID NO: 8561 - RNA, 1701 nt, Artificial Sequence
  derived and/or modified CDS sequence (AUadapt) from InfluenzaA__AFD64315__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccucgaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaaccagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 8562 - RNA, 1701 nt, Artificial Sequence; identical to SEQ ID NO: 8552
  derived and/or modified CDS sequence (AUadapt) from InfluenzaA__AFD64326__HA

SEQ ID NO: 8563 - RNA, 1701 nt, Artificial Sequence; identical to SEQ ID NO: 8522
  derived and/or modified CDS sequence (AUadapt) from InfluenzaA__AFD64337__HA

SEQ ID NO: 8564 - RNA, 1701 nt, Artificial Sequence; identical to SEQ ID NO: 318
  derived and/or modified CDS sequence (AUadapt) from InfluenzaA__AFD64348__HA

SEQ ID NO: 8565 - RNA, 1701 nt, Artificial Sequence; identical to SEQ ID NO: 8522
  derived and/or modified CDS sequence (AUadapt) from InfluenzaA__AFD64359__HA

SEQ ID NO: 8566 - RNA, 1701 nt, Artificial Sequence
  derived and/or modified CDS sequence (AUadapt) from InfluenzaA__AFD64370__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccacugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucucgcuguacgcgcaggccuccggccgcaucaccgugucgacgaagcggagccagcagaccgugaucccgaacaucggcucccgcccccggguccgcgacaucucgucccggaucucgaucuacuggaccaucgugaagcccggggacauccugcucaucaacuccaccggcaaccugaucgcgccccgcggguacuucaagauccggagcggcaaguccucgaucaugcgcuccgacgccccgaucggcaagugcaacucggagugcaucacgcccaacggguccauccccaacgacaagcccuuccagaacgugaaccggaucaccuacggcgccugcccgcgcuacgucaagcagaacacccugaagcucgccaccgggaugcggaacgugcccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucucggaggucgaggggcggauccaggaccuggagaaguacguggaggacacgaagaucgaccugugguccuacaacgccgagcuccugguggcccuggagaaccagcacaccaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 8567 - RNA, 1701 nt, Artificial Sequence; identical to SEQ ID NO: 318
  derived and/or modified CDS sequence (AUadapt) from InfluenzaA__AFD64381__HA

SEQ ID NO: 8568 - RNA, 1701 nt, Artificial Sequence; identical to SEQ ID NO: 8522
  derived and/or modified CDS sequence (AUadapt) from InfluenzaA__AFD64392__HA

SEQ ID NO: 8569 - RNA, 1701 nt, Artificial Sequence; identical to SEQ ID NO: 8512
  derived and/or modified CDS sequence (AUadapt) from InfluenzaA__AFD64403__HA

SEQ ID NO: 8570 - RNA, 1701 nt, Artificial Sequence; identical to SEQ ID NO: 8512
  derived and/or modified CDS sequence (AUadapt) from InfluenzaA__AFD64414__HA

SEQ ID NO: 8571 - RNA, 1701 nt, Artificial Sequence
  derived and/or modified CDS sequence (AUadapt) from InfluenzaA__AFD64425__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccgaacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccucgaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacaacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 8572 - RNA, 1701 nt, Artificial Sequence; identical to SEQ ID NO: 318
  derived and/or modified CDS sequence (AUadapt) from InfluenzaA__AFD64436__HA

SEQ ID NO: 8573 - RNA, 1701 nt, Artificial Sequence; identical to SEQ ID NO: 318
  derived and/or modified CDS sequence (AUadapt) from InfluenzaA__AFD64447__HA

SEQ ID NO: 8574 - RNA, 1701 nt, Artificial Sequence
  derived and/or modified CDS sequence (AUadapt) from InfluenzaA__AFD64458__HA
augaagaccaucaucgcccugucguacauccucugccugguguucgcccagaagcugcccggcaacgacaacuccaccgcgacgcucugccuggggcaccacgccguccagaacggcaccaucgugaagaccaucaccaacgaccagaucgaggugacgaacgccaccgagcugguccagucguccagcaccgggggcaucugcgacuccccgcaccagauccucgacggggagaacugcacccugaucgacgcccugcucggcgacccccagugcgacggcuuccagaacaagaagugggaccuguucguggagcgcucgaaggccuacuccaacugcuaccccuacgacgugcccgacuacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguacccggcccugaacgugaccaugcccaacaacgagaaguucgacaagcucuacaucuggggcguccaccaccccgggaccgacucggaccagaucucccuguacgcgcaggccucgggccggaucaccgugagcacgaagcgcucccagcagaccgugauccccaacaucggcucgcggccgcgcguccgggacguguccucgcgcaucuccaucuacuggaccaucgugaagcccggggacauccugcucaucaacagcaccggcaaccugaucgcgccccggggguacuucaagauccgcuccggcaagucguccaucaugcggucggacgcccccaucggcaagugcaacuccgagugcaucacgccgaacgggagcauccccaacgacaagcccuuccagaacgucaaccgcaucaccuacggcgccugcccccgguacgugaagcagaacacccugaagcucgccaccgggaugcgcaacgugccggagaagcagacgcggggcaucuucggggccaucgccggcuucaucgagaacggcugggaggggauggucgacggcugguacggguuccgccaccagaacuccgagggcaccgggcaggccgccgaccucaagucgacccaggcggccaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 8575 - RNA, 1701 nt, Artificial Sequence; identical to SEQ ID NO: 7100
  derived and/or modified CDS sequence (AUadapt) from InfluenzaA__AFD64795__HA

SEQ ID NO: 8576 - RNA, 1701 nt, Artificial Sequence; identical to SEQ ID NO: 7227
  derived and/or modified CDS sequence (AUadapt) from InfluenzaA__AFD64799__HA

SEQ ID NO: 8577 - RNA, 1701 nt, Artificial Sequence
  derived and/or modified CDS sequence (AUadapt) from InfluenzaA__AFD64802__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccucggggcggaucacgguguccaccaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccgaguacaaggacuggauccuguggaucuccuucgccaucagcugcuuccuccugugcgucgcgcugcucggcuucaucaugugggccugccagaagggcaacauccggugcaacaucugcaucuga

SEQ ID NO: 8578 - RNA, 1701 nt, Artificial Sequence
  derived and/or modified CDS sequence (AUadapt) from InfluenzaA__AFD64804__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcaugauggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 8579 - RNA, 1701 nt, Artificial Sequence
  derived and/or modified CDS sequence (AUadapt) from InfluenzaA__AFD64806__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccucggggcggaucacgguguccaccaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8580 - RNA, 1701 nt, Artificial Sequence
  derived and/or modified CDS sequence (AUadapt) from InfluenzaA__AFD64807__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccucggggcggaucacgguguccaccaagcgcagccagcaggccgugaucccgaacaucggcucgcggccccgcguccgggacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcgccccugggcaagugccacucggccugcaucacgcccaacggcuccauccccaacgacaagccguuccagaacgucaaccgcaucaccuacggggccugcccccgguacgugaagcagaacacccucaagcuggccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcucaaccgccugaucggcaagaccaacgagaaguuccaccagaucgagaaggaguucucggagguggagggccggauccaggaccuggagaaguacguggaggacaccaagaucgaccucugguccuacaacgccgagcugcuggucgcgcucgagaaccagcacacgaucgaccugaccgacucggagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacauguaccgggacgaggcccugaacaaccgcuuccagaucaaggggguggagcugaaguccggcuacaaggacuggauccucuggaucuccuucgccaucagcugcuuccugcugugcguggcgcuccugggcuucaucaugugggccugccagaaggggaacauccggugcaacaucugcaucuga

SEQ ID NO: 8581 - RNA, 1701 nt, Artificial Sequence
  derived and/or modified CDS sequence (AUadapt) from InfluenzaA__AFD64810__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccccgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8582 - RNA, 1701 nt, Artificial Sequence
  derived and/or modified CDS sequence (AUadapt) from InfluenzaA__AFD64812__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaccgaccagaucaacgggaagcugaaccgccucaucggcaagaccaacgagaaguuccaccagaucgagaaggaguucucggagguggagggccggauccaggaccuggagaaguacguggaggacacgaagaucgaccugugguccuacaacgccgagcuccuggucgcgcuggagaaccagcacaccaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcacguacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8583 - RNA, 1701 nt, Artificial Sequence
  derived and/or modified CDS sequence (AUadapt) from InfluenzaA__AFD64814__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccucggggcggaucacgguguccaccaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccccgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8584 - RNA, 1701 nt, Artificial Sequence
  derived and/or modified CDS sequence (AUadapt) from InfluenzaA__AFD64816__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgagaucugcaacucgccccaccagauccucgacggggagaacugcacccugaucgacgcccugcucggcgacccccagugcgacggguuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggcgugacccagaacgggaccuccucggccugcaugcgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcucgcagcaggccgugaucccgaacaucgggucgcggccccgcguccggaacauccccucccgcgugagcaucuacuggaccaucgugaagcccggcgacauccugcucaucaacuccaccggcaaccugaucgccccgcggggguacuucaagauccgcucgggcaaguccagcaucaugcgguccgacgcccccaucgggaagugcaacucggcgugcaucacccccaacggcuccauccccaacgacaagccguuccagaacgucaaccgcaucacguacggcgccugcccccgguacgugaagcagaacacccugaagcucgccaccgggaugcgcaacgugcccgagaagcagacccggggcaucuucggggccaucgccggcuucaucgagaacgggugggagggcauggucgacggcugguacggguuccgccaccagaacucggagggccgggggcaggcggccgaccugaaguccacgcaggccgccaucgaccagaucaacggcaagcugaaccgccucaucgggaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggguacaaggacuggauccuguggaucuccuucgccaucagcugcuuccuccugugcgucgcgcugcucggcuucaucaugugggccugccagaagggcaacauccggugcaacaucugcaucuga

SEQ ID NO: 8585 - RNA, 1701 nt, Artificial Sequence
  derived and/or modified CDS sequence (AUadapt) from InfluenzaA__AFD64818__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcgccccugggcaagugcaucucggccugcaucacgcccaacggcuccauccccaacgacaagccguuccagaacgucaaccgcaucaccuacggggccugcccccgguacgugaagcagaacacccucaagcuggccaccggcaugcgcaacgugcccgagaagcagacgcgggggaucuucggcgccaucgccggguucaucgagaacggcugggagggcauggucgacgggugguacggcuuccgccaccagaacucggaggggcggggccaggcggccgaccugaaguccacccaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacacgaucgaccugaccgacucggagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 8586 - RNA, 1701 nt, Artificial Sequence
  derived and/or modified CDS sequence (AUadapt) from InfluenzaA__AFD64819__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcucgcagcaggccgugaucccgaacaucggcucgcggccccgcauccggaacauccccucccgcgucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaucucggcgugcaucacgcccaacggcuccauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacucggaggggcggggccaggcggccgaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccccgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 8587 - RNA, 1701 nt, Artificial Sequence; identical to SEQ ID NO: 7227
  derived and/or modified CDS sequence (AUadapt) from InfluenzaA__AFD64820__HA

SEQ ID NO: 8588 - RNA, 1701 nt, Artificial Sequence
  derived and/or modified CDS sequence (AUadapt) from InfluenzaA__AFD64822__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcaugcgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8589 - RNA, 1701 nt, Artificial Sequence
  derived and/or modified CDS sequence (AUadapt) from InfluenzaA__AFD64823__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggccgcugcaacuccgccugcaucacccccaacggcucgauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacuccgaggggcgcggccaggccgccgaccucaagucgacgcaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccggaacggcaccuacgaccacgacguguaccgcgacgaggcccucaacaaccgguuccagaucaaggggguggagcugaaguccggcuacaaggacuggauccuguggaucagcuucgcgaucuccugcuuccuccugugcgucgcccugcucggcuucaucaugugggccugccagaaggggaacauccgcugcaacaucugcaucuga

SEQ ID NO: 8590 - RNA, 1701 nt, Artificial Sequence
  derived and/or modified CDS sequence (AUadapt) from InfluenzaA__AFD64824__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccacgagcugcuuccuccugugcgucgcgcugcucggcuucaucaugugggccugccagaaggggaacauccggugcaacaucugcaucuga

SEQ ID NO: 8591 - RNA, 1701 nt, Artificial Sequence; identical to SEQ ID NO: 8579
  derived and/or modified CDS sequence (AUadapt) from InfluenzaA__AFD64825__HA

SEQ ID NO: 8592 - RNA, 1701 nt, Artificial Sequence; identical to SEQ ID NO: 8579
  derived and/or modified CDS sequence (AUadapt) from InfluenzaA__AFD64827__HA

SEQ ID NO: 8593 - RNA, 1701 nt, Artificial Sequence
  derived and/or modified CDS sequence (AUadapt) from InfluenzaA__AFD64828__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcaugauggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccccgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 8594 - RNA, 1701 nt, Artificial Sequence; identical to SEQ ID NO: 8588
  derived and/or modified CDS sequence (AUadapt) from InfluenzaA__AFD64830__HA

SEQ ID NO: 8595 - RNA, 1701 nt, Artificial Sequence; identical to SEQ ID NO: 7227
  derived and/or modified CDS sequence (AUadapt) from InfluenzaA__AFD98095__HA

SEQ ID NO: 8596 - RNA, 1701 nt, Artificial Sequence
  derived and/or modified CDS sequence (AUadapt) from InfluenzaA__AFD98106__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 8597 - RNA, 1701 nt, Artificial Sequence
  derived and/or modified CDS sequence (AUadapt) from InfluenzaA__AFD98128__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcaacucgccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggucgcucgucgccuccucgggcacgcuggaguucaacaacgaguccuucaacuggaccggggugacccagaacggcaccagcuccgccugcauccgcaagucgaacaacuccuucuucucgcggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcgcaucaccguguccacgaagcggagccagcaggccgugaucccgaacaucggcucccgcccccggguccgcaacauccccucgcgggugucgaucuacuggaccaucgugaagcccggcgacauccugcucaucaacuccaccgggaaccugaucgccccgcgcggcuacuucaagauccggucggggaaguccagcaucaugcgcuccgacgcgcccaucggcaagugcaacucggccugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacucggaggggcgcggccaggccgccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucacggacucggagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcucaagucgggcuacaaggacuggauccuguggaucuccuucgcgaucagcugcuuccugcugugcgucgcccugcucggcuucaucaugugggccugccagaaggggaacauccgcugcaacaucugcaucuga

SEQ ID NO: 8598 - RNA, 1701 nt, Artificial Sequence; identical to SEQ ID NO: 7227
  derived and/or modified CDS sequence (AUadapt) from InfluenzaA__AFD98139__HA

SEQ ID NO: 8599 - RNA, 1701 nt, Artificial Sequence
  derived and/or modified CDS sequence (AUadapt) from InfluenzaA__AFD98161__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccgccggggagaucugcgacagcccccaccacauccucgacggcgagaacugcacccugaucgacgcccugcucggggacccccagugcgacggcuuccagaacaagaagugggaccuguucguggagcgcucccgggcguacucgaacugcuaccccuacgacgugccggacuacgccucccugcgcagccucgucgccuccucgggcacccuggaguucaacaacgaguccuucaacuggacgggggugacccagaacggcaccagcuccgccugcauccggcgcucgaacaacuccuucuucucgcggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccgggcgcaucaccgugagcaccaagcggucccagcaggccgugaucccgaacaucggcucgcgcccccggguccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcgcccaucgggaagugcaacuccgagugcaucacccccaacggcucgauccccaacgacaagccguuccagaacgugaaccggaucaccuacggggccugcccccgcuacgucaagcaguccacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggcgcggccaggcggccgaccugaaguccacccaggccgccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 8600 - RNA, 1701 nt, Artificial Sequence
  derived and/or modified CDS sequence (AUadapt) from InfluenzaA__AFD98172__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacgacguguaccgcgacgaggcccucaacaaccgguuccagaucaagggggucgagcugaaguccggcuacaaggacugggugcuguggaucagcuucgccaucuccugcuuccuccugugcguggcgcugcucggcuucaucaugugggccugccagaaggggaacauccgcugcaacaucugcaucuga

SEQ ID NO: 8601 - RNA, 1701 nt, Artificial Sequence
  derived and/or modified CDS sequence (AUadapt) from InfluenzaA__AFD98183__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugcugccgaacaucggcucgcggccccgcguccggaacauccccucccgcgugagcaucuacuggaccaucgugaagcccggcgacauccuccugaucaacuccaccgggaaccugaucgccccgcggggcuacuucaagauccgcucggggaaguccagcaucaugcgguccgacgcccccaucggcaagugcaacucgacgugcaucacccccaacggcuccauccccaacgacaagccguuccagaacgucaaccgcaucaccuacggggcgugcccccgguacgugaagcagaacacccucaagcuggccaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgcggaccugaaguccacccaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcccuccugggcuucaucaugugggcgugccagaaggggaacauccggugcaacaucugcaucuga

SEQ ID NO: 8602 - RNA, 1701 nt, Artificial Sequence; identical to SEQ ID NO: 7100
  derived and/or modified CDS sequence (AUadapt) from InfluenzaA__AFD98194__HA

SEQ ID NO: 8603 - RNA, 1701 nt, Artificial Sequence; identical to SEQ ID NO: 7154
  derived and/or modified CDS sequence (AUadapt) from InfluenzaA__AFD98205__HA

SEQ ID NO: 8604 - RNA, 1701 nt, Artificial Sequence; identical to SEQ ID NO: 8596
  derived and/or modified CDS sequence (AUadapt) from InfluenzaA__AFD98215__HA

SEQ ID NO: 8605 - RNA, 1701 nt, Artificial Sequence; identical to SEQ ID NO: 7227
  derived and/or modified CDS sequence (AUadapt) from InfluenzaA__AFD98226__HA

SEQ ID NO: 8606 - RNA, 1701 nt, Artificial Sequence
  derived and/or modified CDS sequence (AUadapt) from InfluenzaA__AFD98237__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcaacucgccccaccagauccucgacggcgagaacugcacccugaucgacgcccugcucggggacccccagugcgacggcuuccagaacaagaagugggaccuguucguggagcgcuccaaggcccacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcagccagcaggccgugaucccgaacaucggcucccggccccgcguccggaacauccccucgcgcguguccaucuacuggaccaucgugaagcccggcgacauccugcucaucaacucgaccgggaaccugaucgccccgcggggcuacuucaagauccgcuccggcaagagcuccaucaugcggucggacgcccccaucgggaagugcaacuccgcgugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggucguacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 8607 - RNA, 1701 nt, Artificial Sequence; identical to SEQ ID NO: 8599
  derived and/or modified CDS sequence (AUadapt) from InfluenzaA__AFD98248__HA

SEQ ID NO: 8608 - RNA, 1701 nt, Artificial Sequence
  derived and/or modified CDS sequence (AUadapt) from InfluenzaA__AFD98259__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccacauccucgacggcgagaacugcacccugaucgacgcccugcucggggacccccagugcgacggcuuccagaacaagaagugggaccuguucguggagcgcagcaaggcguacuccaacugcuaccccuacgacgugcaggacuacgccucgcugcggucccucgucgccagcuccggcacccuggaguucaacaacgagucguucaacuggacgggggugacccagaacggcaccuccagcgccugcauccgccgguccaacaacucguucuucucccgccugaacuggcucacccaccugaacuucaaguacccggcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcucgcagcaggccgugauccccaacaucggcagccggccgcgcguccggaacauccccucccgcaucucgaucuacuggacgaucgugaagcccggcgacauccugcucaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgucaagcagucgacgcugaagcucgccaccggcaugcgcaacgugcccgagaagcagacccgggggaucuucggcgccaucgccggguucaucgagaacggcugggagggcaugauggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 8609 - RNA, 1701 nt, Artificial Sequence
  derived and/or modified CDS sequence (AUadapt) from InfluenzaA__AFD98270__HA
augaaggccauccuggugguccuccuguacaccuucgugaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcgugacgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgucagcuccuucgagcgcuucgagaucuuccccaacaccucguccuggcccaaccacgacagcaacaagggcgugaccgccgcgugcccgcacgccggcgccaaguccuucuacaagaaccugaucuggcucgugaagaaggggaacucguaccccaagcuguccaagagcuacaucaacgacaagggcaaggagguccuggugcucugggggauccaccaccccucgacgaccgccgaccagcagucccuguaccagaacgcggacgccuacguguucgucggcaccucgcgguacuccaagaaguucaagcccgagaucgccauccgcccgaaggugcgggaccaggagggccgcaugaacuacuacuggacccugguggagcccggggacaagaucacguucgaggccaccggcaaccucgucgugccccgguacgccuucgcgauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgucaaguccacgaagcugcggcucgccaccggccugcgcaacgugccgagcauccagucccgggggcuguucggcgccaucgcgggguucaucgagggcggcuggaccgggaugguggacggcugguacggguaccaccaccagaacgagcagggcucgggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggccaucuacuccaccguggccucgucccuggugcucgucgugagccugggggcgaucucguucuggaugugcuccaacggcagccugcagugccggaucugcaucuga

SEQ ID NO: 8610 - RNA, 1701 nt, Artificial Sequence
  derived and/or modified CDS sequence (AUadapt) from InfluenzaA__AFD98280__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgacucgcuguccaccgcccggagcugguccuacaucguggagaccucguccucggacaacggcacgugcuaccccggcgacuucaucgacuacgaggagcuccgcgagcagcuguccagcguguccucguucgagcgguucgagaucuuccccaagaccuccucguggcccaaccacgacuccaacaagggggucaccgccgccugcccgcacgccggcgcgaagggguucuacaagaaccugaucuggcucgugaagaagggcaacagcuaccccaagcuguccaagucguacaucaacgacaaggggaaggaggugcugguccucuggggcauccaccaccccuccaccacggccgaccagcagucgcuguaccagaacgccgacaccuacguguucgugggcaccagccgcuacuccaagaaguucaagcccgagaucgccauccggccgaagguccgcgaccaggaggggcggaugaacuacuacuggacccugguggagcccggcgacaagaucacguucgaggccaccgggaaccucguggucccccgcuacgcguucgccauggagcggaacgccggcucgggcaucaucaucuccgacacccccgugcacgacugcaacaccacgugccagaccccgaagggggccaucaacaccucgcugcccuuccagaacauccaccccaucaccaucggcaagugccccaaguacgugaaguccacgaagcugcgccucgccaccgggcugcggaacgucccgagcauccagucccgcggccuguucggggcgaucgccggcuucaucgagggcggguggaccggcaugguggacgggugguacggcuaccaccaccagaacgagcaggggucgggcuacgccgccgaccucaaguccacccagaacgccaucgacaagaucacgaacaaggugaacucggucaucgagaagaugaacacccaguucaccgcggugggcaaggaguucaaccaccuggagaagcggaucgagaaccugaacaagaaggucgacgacggguuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagucgacccggaucuaccagauccuggccaucuacuccaccgucgcgucgucccuggugcucguggucagccugggcgccaucuccuucuggaugugcucgaacggcagccugcagugccgcaucugcaucuga

SEQ ID NO: 8611 - RNA, 1701 nt, Artificial Sequence; identical to SEQ ID NO: 8588
  derived and/or modified CDS sequence (AUadapt) from InfluenzaA__AFD98290__HA

SEQ ID NO: 8612 - RNA, 1701 nt, Artificial Sequence; identical to SEQ ID NO: 7331
  derived and/or modified CDS sequence (AUadapt) from InfluenzaA__AFD98310__HA

SEQ ID NO: 8613 - RNA, 1701 nt, Artificial Sequence; identical to SEQ ID NO: 6699
  derived and/or modified CDS sequence (AUadapt) from InfluenzaA__AFD98320__HA

SEQ ID NO: 8614 - RNA, 1701 nt, Artificial Sequence; identical to SEQ ID NO: 8599
  derived and/or modified CDS sequence (AUadapt) from InfluenzaA__AFD98340__HA

SEQ ID NO: 8615 - RNA, 1701 nt, Artificial Sequence
  derived and/or modified CDS sequence (AUadapt) from InfluenzaA__AFD98351__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccucggccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccucggggcgcaucaccguguccaccaagcggagccagcaggccgugaucccgaacaucggcucgcgcccccggguccgcaacauccccucccggaucagcaucuacuggacgaucgugaagcccggcgacauccugcucaucaacuccaccgggaaccugaucgccccgcgcggcuacuucaagauccggucggggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggaccauccggaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 8616 - RNA, 1701 nt, Artificial Sequence
  derived and/or modified CDS sequence (AUadapt) from InfluenzaA__AFD98362__HA
augaagaccaucaucgcccugucguacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacccuggaguucaacaacgaguccuucaacuggacgggggugacccagaacggcaccucguccgccugcauccgccggagcaacaacuccuucuucucgcgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccuccgggcggaucaccgugagcaccaagcgcggccagcaggccgugaucccgaacaucggcucccggccccgcguccggaacauccccucgcgcaucucgaucuacuggacgaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacccccaacggguccauccccaacgacaagccguuccagaacgugaaccgcaucaccuacggcgcgugcccccgguacgucaagcagaacacgcugaagcucgccaccgggaugcgcaacgugcccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucgucggcaagacgaacgagaaguuccaccagaucgagaaggaguucucggagguggaggggcggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 8617 - RNA, 1701 nt, Artificial Sequence; identical to SEQ ID NO: 8596
  derived and/or modified CDS sequence (AUadapt) from InfluenzaA__AFD98373__HA

SEQ ID NO: 8618 - RNA, 1701 nt, Artificial Sequence; identical to SEQ ID NO: 7227
  derived and/or modified CDS sequence (AUadapt) from InfluenzaA__AFD98384__HA

SEQ ID NO: 8619 - RNA, 1701 nt, Artificial Sequence
  derived and/or modified CDS sequence (AUadapt) from InfluenzaA__AFD98395__HA
augaagaccaucaucgcccugucguacauccucugccugguguucgcccagaagcugcccggcgacgacaacuccaccgcgacgcucugccuggggcaccacgccgucccgaacggcaccaucgugaagaccaucaccaacgaccagaucgaggugacgaacgccaccgagcugguccagaacucguccgccggggagaucugcgacagcccccaccacauccucgacggcgagaacugcacccugaucgacgcccugcucggggacccccagugcgacggcuuccagaacaagaagugggaccuguucguggagcgcucccgggcguacucgaacugcuaccccuacgacgugccggacuacgccucccugcgcagccucgucgccuccucgggcacccuggaguucaacaacgaguccuucaacuggacgggggugacccagaacggcaccagcuccgccugcauccggcgcucgaacaacuccuucuucucgcggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccgggcgcaucaccgugagcaccaagcggucccagcaggccgugaucccgaacaucggcucgcgcccccggguccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcgcccaucgggaagugcaacuccgagugcaucacccccaacggcucgauccccaacgacaagccguuccagaacgugaaccggaucaccuacggggccugcccccgcuacgucaagcaguccacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggcgcggccaggcggccgaccugaaguccacccaggccgccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 8620 - RNA, 1701 nt, Artificial Sequence; identical to SEQ ID NO: 8596
  derived and/or modified CDS sequence (AUadapt) from InfluenzaA__AFD98406__HA

SEQ ID NO: 8621 - RNA, 1701 nt, Artificial Sequence; identical to SEQ ID NO: 8599
  derived and/or modified CDS sequence (AUadapt) from InfluenzaA__AFD98417__HA

SEQ ID NO: 8622 - RNA, 1701 nt, Artificial Sequence
  derived and/or modified CDS sequence (AUadapt) from InfluenzaA__AFD98428__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccucggggcggaucacgguguccaccaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucacgaucagcugcuuccuccugugcgucgcccugcucggcuucaucaugugggcgugccagaaggggaacauccggugcaacaucugcaucuga

SEQ ID NO: 8623 - RNA, 1701 nt, Artificial Sequence; identical to SEQ ID NO: 7112
  derived and/or modified CDS sequence (AUadapt) from InfluenzaA__AFD98439__HA

SEQ ID NO: 8624 - RNA, 1701 nt, Artificial Sequence
  derived and/or modified CDS sequence (AUadapt) from InfluenzaA__AFD98449__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacaacgagaacuucaacuggaccggggugacccagaacggcaccagcuccgccugcauccgccggucgaagaacuccuucuucagccgccugaacuggcucacgcaccugaacuucaaguuccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcucccagcagaccgccaucccgaacaucggcucgcggccccgcgugcggaacauccccagccgcaucuccaucuacuggaccaucgucaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccucaagucgacccaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 8625 - RNA, 1701 nt, Artificial Sequence
  derived and/or modified CDS sequence (AUadapt) from InfluenzaA__AFD98460__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucggccggggagaucugcgacagcccccaccacauccucgacggcgagaacugcacccugaucgacgcccugcucggggacccccagugcgacggcuuccagaacaagaagugggaccuguucguggagcgcucgcgggcguacuccaacugcuaccccuacgacgugccggacuacgccagccugcgcucccucgucgccucguccggcacccuggaguucaacaacgagagcuucaacuggacgggggugacccagaacggcaccuccucggccugcauccggcgcuccaacaacagcuucuucuccaagcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccucggggcggaucaccguguccaccaagcgcagccagcaggccgugaucccgaacaucggcucgcggccccgcguccggaacauccccucccgcaucagcaucuacuggacgaucgugaagcccggcgacauccugcucaucaacuccaccgggaaccugaucgccccgcggggcuacuucaagauccgcucggggaaguccagcaucaugcgguccgacgcgcccaucggcaagugcaacucggagugcaucacccccaacggcuccauccccaacgacaagccguuccagaacgugaaccgcaucaccuacggggccugcccccgguacgucaagcagagcacgcugaagcucgccaccggcaugcgcaacgugcccgagaagcagacccgggggaucuucggcgccaucgccggguucaucgagaacggcugggagggcaugauggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggucguacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccgcaacggcaccuacgaccacgacguguaccgggacgaggcccucuccaaccgcuuccagaucaagggggucgagcucaagucgggcuacaaggacuggauccuguggaucuccuucgccaucagcugcuuccugcugugcguggcgcugcucggcuucaucaugugggccugccagaaggggaacauccggugcaacaucugcaucuga

SEQ ID NO: 8626 - RNA, 1701 nt, Artificial Sequence; identical to SEQ ID NO: 7112
  derived and/or modified CDS sequence (AUadapt) from InfluenzaA__AFD98471__HA

SEQ ID NO: 8627 - RNA, 1701 nt, Artificial Sequence
  derived and/or modified CDS sequence (AUadapt) from InfluenzaA__AFD98481__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcaacucgccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggucgcucgucgccuccucgggcacgcuggaguucaacaacgaguccuucaacuggaccggggugacccagaacggcaccagcuccgccugcauccgccggucgaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccguguccacgaagcgcagccagcaggccgugaucccgaacaucggcucccggccccgcguccggaacauccccucgcgcgugucgaucuacuggaccaucgugaagcccggcgacauccugcucaucaacuccaccgggaaccugaucgccccgcggggcuacuucaagauccgcucggggaaguccagcgucaugcgguccgacgcgcccaucggcaagugcaacucggccugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgcgggguucaucgagaacggcugggagggcaugguggacgggugguacggcuuccgccaccagaacucggaggggcggggccaggccgccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgcggagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcucaagucgggcuacaaggacuggauccuguggaucuccuucgcgaucagcugcuuccugcugugcguggcccugcucggcuucaucaugugggccugccagaaggggaacauccggugcaacaucugcaucuga

SEQ ID NO: 8628 - RNA, 1701 nt, Artificial Sequence; identical to SEQ ID NO: 7227
  derived and/or modified CDS sequence (AUadapt) from InfluenzaA__AFD98492__HA

SEQ ID NO: 8629 - RNA, 1701 nt, Artificial Sequence
  derived and/or modified CDS sequence (AUadapt) from InfluenzaA__AFD98503__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagaccaaggggaucuucggcgccaucgccggguucaucgagaacggcugggagggcaugauggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 8630 - RNA, 1701 nt, Artificial Sequence; identical to SEQ ID NO: 7227
  derived and/or modified CDS sequence (AUadapt) from InfluenzaA__AFD98514__HA

SEQ ID NO: 8631 - RNA, 1701 nt, Artificial Sequence; identical to SEQ ID NO: 8579
  derived and/or modified CDS sequence (AUadapt) from InfluenzaA__AFD98525__HA

SEQ ID NO: 8632 - RNA, 1701 nt, Artificial Sequence; identical to SEQ ID NO: 7100
  derived and/or modified CDS sequence (AUadapt) from InfluenzaA__AFD98558__HA

SEQ ID NO: 8633 - RNA, 1701 nt, Artificial Sequence
  derived and/or modified CDS sequence (AUadapt) from InfluenzaA__AFD98569__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccucggggcggaucacgguguccaccaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacgagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8634 - RNA, 1701 nt, Artificial Sequence; identical to SEQ ID NO: 7100
  derived and/or modified CDS sequence (AUadapt) from InfluenzaA__AFD98580__HA

SEQ ID NO: 8635 - RNA, 1701 nt, Artificial Sequence
  derived and/or modified CDS sequence (AUadapt) from InfluenzaA__AFE02942__HA
augaaggccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgcgucguccuggagcuacaucgucgagaccuccaacucggacaacggcacgugcuaccccggcgacuucaucgacuacgaggagcugcgggagcagcuguccagcguguccucguucgagcgcuucgagaucuuccccaagaccuccagcuggcccaaccacgacuccaacaagggggugaccgccgccugcccgcacgccggcgccaagucguucuacaagaaccucaucuggcuggucaagaaggggaacuccuaccccaagcugagcaaguccuacaucaacgacaagggcaaggaggugcucgugcugugggggauccaccaccccucgaccagcgccgaccagcagucccuguaccagaacgccgacgccuacgucuucguguggacgucgcgguacuccaagaaguucaagcccgagaucgccauccgcccgaaggugcgggaccaggagggccgcaugaacuacuacuggacccucgucgagcccggcgacaagaucaccuucgaggcgaccgggaaccugguggugccccgguacgccuucgccauggaccgcaacgccggcagcgggaucaucaucuccgacacgcccguccacgacugcaacacgaccugccagaccccgaagggcgccaucaacaccucgcugcccuuccagaacauccaccccaucaccaucggcaagugccccaaguacgugaaguccaccaagcuccggcuggcgaccgggcugcgcaacgugccgagcauccagucccggggccucuucggggccaucgccggcuucaucgagggcggguggacgggcauggucgacgggugguacggcuaccaccaccagaacgagcaggggucgggcuacgccgccgaccugaaguccacccagaacgcgaucgacgagaucaccaacaaggugaacagcgugaucgagaagaugaacacccaguucacggccgucgggaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcucgcagcugaagaacaacgccaaggagaucggcaacgggugcuucgaguucuaccacaagugcgacaacacgugcauggaguccgucaagaacggcaccuacgacuaccccaaguacagcgaggaggccaagcucaaccgggaggagaucgacggggugaagcuggaguccacccgcaucuaccagauccuggcgaucuacucgaccguggccuccagccucguccugguggugucgcugggcgccaucuccuucuggaugugcagcaacgggucccuccagugccggaucugcaucuga

SEQ ID NO: 8636 - RNA, 1701 nt, Artificial Sequence; identical to SEQ ID NO: 4078
  derived and/or modified CDS sequence (AUadapt) from InfluenzaA__AFE18688__HA

SEQ ID NO: 8637 - RNA, 1701 nt, Artificial Sequence; identical to SEQ ID NO: 895
  derived and/or modified CDS sequence (AUadapt) from InfluenzaA__AFE47624__HA

SEQ ID NO: 8638 - RNA, 1701 nt, Artificial Sequence; identical to SEQ ID NO: 1645
  derived and/or modified CDS sequence (AUadapt) from InfluenzaA__AFE47635__HA

SEQ ID NO: 8639 - RNA, 1701 nt, Artificial Sequence; identical to SEQ ID NO: 7227
  derived and/or modified CDS sequence (AUadapt) from InfluenzaA__AFF18506__HA

SEQ ID NO: 8640 - RNA, 1701 nt, Artificial Sequence
  derived and/or modified CDS sequence (AUadapt) from InfluenzaA__AFF57124__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggagaacucguaccccaagcuguccaagagcuacaucaacgacaaggggaaggaggugcugguccucuggggcauccaccaccccucgaccacggccgaccagcagcggcuguaccagaacgccgacgccuacguguucguggggaccucccgcuacagcaagaaguucaagcccgagaucgccauccggccgaagguccgcgaccaggagggccggaugaacuacuacuggacccugguggagcccggcgacaagaucaccuucgaggcgacggggaaccucguggucccccgcuacgccuucgccauggagcggaacgccggcuccgggaucaucaucucggacacccccgugcacgacugcaacacgaccugccagaccccgaagggcgccaucaacaccucccugcccuuccagaacauccaccccaucaccaucggcaagugccccaaguacgucaagucgaccaagcugcgccucgcgacggggcugcggaacgugccguccauccagagccgcggccuguucggggccaucgccggcuucaucgagggcggguggaccggcaugguggacgggugguacggcuaccaccaccagaacgagcagggguccggcuacgccgccgaccucaagucgacccagaacgcgaucgacaagaucaccaacaaggugaacuccgucaucgagaagaugaacacgcaguucaccgccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggcgaucuacucgaccgucgccuccagccuggugcucguggucucccugggcgccaucucguucuggaugugcagcaacgggucccugcagugccgcaucugcaucuga

SEQ ID NO: 8641 - RNA, 1701 nt, Artificial Sequence
  derived and/or modified CDS sequence (AUadapt) from InfluenzaA__AFF57128__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcaguccaucuaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucaccaucgggaagugccccaaguacgugaaguccaccaagcugcggcuggcgacgggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucaccaacaaggugaacucggucaucgagaagaugaacacgcaguucaccgccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgucccuggugcugguggucagccucggggccaucucguucuggaugugcuccaacggcagccugcagugccggaucugcaucuga

SEQ ID NO: 8642 - RNA, 1701 nt, Artificial Sequence
  derived and/or modified CDS sequence (AUadapt) from InfluenzaA__AFF57132__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgaucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacgagaccuacgacuaccccaaguacucggaggaggccaagcugaaccgggaggagaucgacggcgugaagcuggaguccacccgcaucuaccagauccucgccaucuacucgaccgucgcguccagccuggugcugguggucucccucggggccaucucguucuggaugugcagcaacggcucccugcagugccggaucugcaucuga

SEQ ID NO: 8643 - RNA, 1701 nt, Artificial Sequence
  derived and/or modified CDS sequence (AUadapt) from InfluenzaA__AFF57136__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccguguacgacugcaacacgaccugccagaccccgaagggcgccaucaacaccucgcugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 8644 - RNA, 1701 nt, Artificial Sequence
  derived and/or modified CDS sequence (AUadapt) from InfluenzaA__AFF57144__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgacgaccagcagucgcuguaccagaacgaggacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggccaccggcaaccucguggucccccgcuacgccuucgcgauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgccaccggccugcggaacgucccgucgauccagucccgcgggcuguucggcgccaucgcgggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggccaucuacagcaccgucgccucgucccuggugcucguggucagccugggggcgaucuccuucuggaugugcagcaacggcucccugcagugccgcaucugcaucuga

SEQ ID NO: 8645 - RNA, 1701 nt, Artificial Sequence
  derived and/or modified CDS sequence (AUadapt) from InfluenzaA__AFF57148__HA
augaaggccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccucguccuggagcuacaucgucgagaccuccucguccgacaacggcacgugcuaccccggcgacuucaucgacuacgaggagcugcgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccucaucuggcuggucaagaaggggaacagcuaccccaagcuguccaagucguacaucaacgacaagggcaaggaggugcucgugcugugggggauccaccaccccagcaccuccgacgaccagcagucgcuguaccagaacgaggacgccuacgucuucgugggcuccagccgguacuccaagaaguucaagcccgagaucgccauccgcccgaaggugcgggaccgcgagggccggaugaacuacuacuggacgcucgucgagcccggggacaagaucaccuucgaggccaccggcaaccugguggugccccgcuacgccuucgcgauggagcggaacgccgggucgggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcuccgccuggccaccggccugcggaacgugccgucgauccagucccgcggccucuucggggccaucgcgggguucaucgagggcggcuggaccgggauggucgacggcugguacggguaccaccaccagaacgagcagggcagcggguacgccgccgaccugaaguccacgcagaacgccaucgacgagaucaccaacaaggugaacucggugaucgagaagaugaacacccaguucaccgccgucggcaaggaguucaaccaccuggagaagcggaucgagaaccucaacaagaagguggacgacggcuuccuggacaucuggacguacaacgcggagcugcucguccugcuggagaacgagcgcacccucgacuaccacgacuccaacgugaagaaccuguacgagaaggugcggagccagcugaagaacaacgccaaggagaucgggaacggcugcuucgaguucuaccacaagugcgacaacacgugcauggaguccgucaagaacgggaccuacgacuaccccaaguacucggaggaggccaagcucaaccgcgaggagaucgacggcgugaagcuggaguccacccggaucuaccagauccuggccaucuacagcaccguggccucgucccucguccugguggugagccugggggcgaucuccuucuggaugugcagcaacggcucccuccagugccgcaucugcaucuga

SEQ ID NO: 8646 - RNA, 1701 nt, Artificial Sequence
  derived and/or modified CDS sequence (AUadapt) from InfluenzaA__AFF57160__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccgagucguacaucaacgacaagggcaaggaggugcugguccucugggggauccaccaccccagcaccuccgccgaccagcagucgcuguaccagaacgaggacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggccaccggcaaccucguggucccccgcuacgcguucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgccaccggccugcggaacgucccgucgauccagucccgcgggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggccaucuacagcaccgucgcgucgucccuggugcucguggucagccugggggccaucuccuucuggaugugcagcaacggcucccugcagugccgcaucugcaucuga

SEQ ID NO: 8647 - RNA, 1701 nt, Artificial Sequence
  derived and/or modified CDS sequence (AUadapt) from InfluenzaA__AFF57164__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagagccuguccaccgccucguccuggagcuacaucguggagaccuccucguccgacaacgggacgugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggguccagccgguacuccaagaaguucaagcccgagaucgccauccgcccgaagguccgggaccgcgagggccggaugaacuacuacuggacgcugguggagcccggcgacaagaucaccuucgaggcgaccgggaaccucguggucccccgcuacgccuucgccauggagcggaacgccggcucggggaucaucaucuccgacacccccgugcacgacugcaacacgaccugccagaccccgaagggcgccaucaacaccagccugcccuuccagaacauccaccccaucacgaucggcaagugccccaaguacgugaaguccaccaagcugcgccucgcgaccgggcugcggaacgucccgucgauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacgggucccugcagugccgcaucugcaucuga

SEQ ID NO: 8648 - RNA, 1701 nt, Artificial Sequence; identical to SEQ ID NO: 8647
  derived and/or modified CDS sequence (AUadapt) from InfluenzaA__AFF57168__HA

SEQ ID NO: 8649 - RNA, 1701 nt, Artificial Sequence
  derived and/or modified CDS sequence (AUadapt) from InfluenzaA__AFF57172__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgaggacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggccaccggcaaccucguggucccccgcuacgcguucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgccaccggccugcggaacgucccgucgauccagucccgcgggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggccaucuacagcaccgucgcgucgucccuggugcucguggucagccugggggccaucuccuucuggaugugcagcaacggcucccugcagugccgcaucugcaucuga

SEQ ID NO: 8650 - RNA, 1701 nt, Artificial Sequence
  derived and/or modified CDS sequence (AUadapt) from InfluenzaA__AFF57176__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggagaacagcuaccccaagcuguccaagucguacaucaacgacaaggggaaggaggugcugguccucuggggcauccaccaccccagcaccuccgccgaccagcagucgcuguaccagaacgccgacgccuacguguucgugggguccagccgguacuccaagaaguucaagcccgagaucgccauccgcccgaagguccgggaccgcgagggccggaugaacuacuacuggacgcugguggagcccggcgacaagaucaccuucgaggcgaccgggaaccucguggucccccgcuacgccuucgccauggagcggaacgccggcucggggaucaucaucuccgacacccccgugcacgacugcaacacgaccugccagaccccgaagggcgccaucaacaccagccugcccuuccagaacauccaccccaucacgaucggcaagugccccaaguacgugaaguccaccaagcugcgccucgcgaccgggcugcggaacgucccgucgauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacgggucccugcagugccgcaucugcaucuga

SEQ ID NO: 8651 - RNA, 1701 nt, Artificial Sequence
  derived and/or modified CDS sequence (AUadapt) from InfluenzaA__AFF57184__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggagaacagcuaccagaagcuguccaagucguacaucaacgacaaggggaaggaggugcugguccucuggggcauccaccaccccagcaccuccgccgaccagcagucgcuguaccagaacgccgacgccuacguguucgugggguccagccgguacuccaagaaguucaagcccgagaucgccauccgccccaagguccgggaccgcgagggccggaugaacuacuacuggacgcugguggagccgggcgacaagaucaccuucgaggcgaccgggaaccucguggucccccgcuacgccuucgccauggagcggaacgccggcucggggaucaucaucuccgacacccccgugcacgacugcaacacgaccugccagacccccaagggcgccaucaacaccagccugccguuccagaacauccaccccaucacgaucggcaagugccccaaguacgugaaguccaccaagcugcgccucgcgaccgggcugcggaacguccccucgauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuacccgaaguacucggaggaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacgggucccugcagugccgcaucugcaucuga

SEQ ID NO: 8652 - RNA, 1701 nt, Artificial Sequence; identical to SEQ ID NO: 8644
  derived and/or modified CDS sequence (AUadapt) from InfluenzaA__AFF57188__HA

SEQ ID NO: 8653 - RNA, 1707 nt, Artificial Sequence
  derived and/or modified CDS sequence (AUadapt) from InfluenzaA__AFF60787__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccacgaucaagcggucguacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccgaggugaacgggcagagcggccggauggaguucuucuggacgauccucaagcccaacgacgccaucaacuucgagucgaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacucgccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagucggugcggaacggcaccuacgacuacccccaguacuccgaggaggcccgccucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 8654 - RNA, 1701 nt, Artificial Sequence
  derived and/or modified CDS sequence (AUadapt) from InfluenzaA__AFG29042__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuucuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucgccauggagcgcaacgccgggucgggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgugccgucgauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccuccucgcugguccucguggugagccugggggccaucuccuucuggaugugcagcaacggcucccugcagugccggaucugcaucuga

SEQ ID NO: 8655 - RNA, 1701 nt, Artificial Sequence
  derived and/or modified CDS sequence (AUadapt) from InfluenzaA__AFG29044__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacccccaacuccgacaacggcacgugcuaccccggcgacuucaucgacuacgaggagcuccgggagcagcugucguccgugagcuccuucgagcgcuucgagaucuuccccaagaccucguccuggccgaaccacgacagcaacaagggggucaccgccgccugcccccacgccggcgcgaaguccuucuacaagaaccugaucuggcucgugaagaaggggaacucguaccccaagcuguccaagucguacaucaacgacaagggcaaggaggugcugguccucugggggauccaccacccgcccaccuccacggaccagcagagccuguaccagaacgccgacgccuacguguucgugggcaccucgcgguacuccaagaaguucaagcccgagaucgccauccgccccaagguccggggccaggaggggcgcaugaacuacuacuggacccugguggagcccggcgacaagaucaccuucgaggccacggggaaccucguggucccgcgguacgcguucgccauggagcgcaacgccggcagcggcaucaucaucuccgacacccccgugcacgacugcaacacgaccugccagacccccaagggggccaucaacaccucgcugcccuuccagaacauccacccgaucaccaucggcaagugccccaaguacgugaaguccaccaagcugcggcucgccacggggcugcgcaacguccccucgauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucaccaacaaggugaacucggucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 8656 - RNA, 1701 nt, Artificial Sequence; identical to SEQ ID NO: 116
  derived and/or modified CDS sequence (AUadapt) from InfluenzaA__AFG31060__HA

SEQ ID NO: 8657 - RNA, 1701 nt, Artificial Sequence; identical to SEQ ID NO: 5469
  derived and/or modified CDS sequence (AUadapt) from InfluenzaA__AFG31070__HA

SEQ ID NO: 8658 - RNA, 1701 nt, Artificial Sequence; identical to SEQ ID NO: 62
  derived and/or modified CDS sequence (AUadapt) from InfluenzaA__AFG31080__HA

SEQ ID NO: 8659 - RNA, 1701 nt, Artificial Sequence
  derived and/or modified CDS sequence (AUadapt) from InfluenzaA__AFG31100__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgaccugaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugaucgugucgcugggggccaucuccuucuggaugugcagcaacggcucccuccagugccggaucugcaucuga

SEQ ID NO: 8660 - RNA, 1701 nt, Artificial Sequence; identical to SEQ ID NO: 116
  derived and/or modified CDS sequence (AUadapt) from InfluenzaA__AFG31110__HA

SEQ ID NO: 8661 - RNA, 1701 nt, Artificial Sequence; identical to SEQ ID NO: 3156
  derived and/or modified CDS sequence (AUadapt) from InfluenzaA__AFG31120__HA

SEQ ID NO: 8662 - RNA, 1701 nt, Artificial Sequence; identical to SEQ ID NO: 3156
  derived and/or modified CDS sequence (AUadapt) from InfluenzaA__AFG31130__HA

SEQ ID NO: 8663 - RNA, 1701 nt, Artificial Sequence; identical to SEQ ID NO: 3156
  derived and/or modified CDS sequence (AUadapt) from InfluenzaA__AFG31140__HA

SEQ ID NO: 8664 - RNA, 1701 nt, Artificial Sequence; identical to SEQ ID NO: 4016
  derived and/or modified CDS sequence (AUadapt) from InfluenzaA__AFG31150__HA

SEQ ID NO: 8665 - RNA, 1701 nt, Artificial Sequence; identical to SEQ ID NO: 4016
  derived and/or modified CDS sequence (AUadapt) from InfluenzaA__AFG31160__HA

SEQ ID NO: 8666 - RNA, 1701 nt, Artificial Sequence; identical to SEQ ID NO: 116
  derived and/or modified CDS sequence (AUadapt) from InfluenzaA__AFG31170__HA

SEQ ID NO: 8667 - RNA, 1701 nt, Artificial Sequence; identical to SEQ ID NO: 116
  derived and/or modified CDS sequence (AUadapt) from InfluenzaA__AFG31180__HA

SEQ ID NO: 8668 - RNA, 1701 nt, Artificial Sequence; identical to SEQ ID NO: 116
  derived and/or modified CDS sequence (AUadapt) from InfluenzaA__AFG31190__HA

SEQ ID NO: 8669 - RNA, 1701 nt, Artificial Sequence; identical to SEQ ID NO: 116
  derived and/or modified CDS sequence (AUadapt) from InfluenzaA__AFG31200__HA

SEQ ID NO: 8670 - RNA, 1701 nt, Artificial Sequence; identical to SEQ ID NO: 116
  derived and/or modified CDS sequence (AUadapt) from InfluenzaA__AFG31210__HA

SEQ ID NO: 8671 - RNA, 1701 nt, Artificial Sequence; identical to SEQ ID NO: 116
  derived and/or modified CDS sequence (AUadapt) from InfluenzaA__AFG31220__HA

SEQ ID NO: 8672 - RNA, 1701 nt, Artificial Sequence; identical to SEQ ID NO: 5469
  derived and/or modified CDS sequence (AUadapt) from InfluenzaA__AFG31230__HA

SEQ ID NO: 8673 - RNA, 1701 nt, Artificial Sequence; identical to SEQ ID NO: 116
  derived and/or modified CDS sequence (AUadapt) from InfluenzaA__AFG31240__HA

SEQ ID NO: 8674 - RNA, 1701 nt, Artificial Sequence; identical to SEQ ID NO: 116
  derived and/or modified CDS sequence (AUadapt) from InfluenzaA__AFG31250__HA

SEQ ID NO: 8675 - RNA, 1701 nt, Artificial Sequence; identical to SEQ ID NO: 116
  derived and/or modified CDS sequence (AUadapt) from InfluenzaA__AFG31260__HA

SEQ ID NO: 8676 - RNA, 1701 nt, Artificial Sequence; identical to SEQ ID NO: 116
  derived and/or modified CDS sequence (AUadapt) from InfluenzaA__AFG31270__HA

SEQ ID NO: 8677 - RNA, 1701 nt, Artificial Sequence; identical to SEQ ID NO: 116
  derived and/or modified CDS sequence (AUadapt) from InfluenzaA__AFG31280__HA

SEQ ID NO: 8678 - RNA, 1701 nt, Artificial Sequence; identical to SEQ ID NO: 116
  derived and/or modified CDS sequence (AUadapt) from InfluenzaA__AFG31290__HA

SEQ ID NO: 8679 - RNA, 1701 nt, Artificial Sequence
  derived and/or modified CDS sequence (AUadapt) from InfluenzaA__AFG31300__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacaucaaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 8680 - RNA, 1701 nt, Artificial Sequence; identical to SEQ ID NO: 5469
  derived and/or modified CDS sequence (AUadapt) from InfluenzaA__AFG31310__HA

SEQ ID NO: 8681 - RNA, 1701 nt, Artificial Sequence; identical to SEQ ID NO: 116
  derived and/or modified CDS sequence (AUadapt) from InfluenzaA__AFG31323__HA

SEQ ID NO: 8682 - RNA, 1701 nt, Artificial Sequence; identical to SEQ ID NO: 116
  derived and/or modified CDS sequence (AUadapt) from InfluenzaA__AFG31333__HA

SEQ ID NO: 8683 - RNA, 1701 nt, Artificial Sequence; identical to SEQ ID NO: 116
  derived and/or modified CDS sequence (AUadapt) from InfluenzaA__AFG31343__HA

SEQ ID NO: 8684 - RNA, 1701 nt, Artificial Sequence; identical to SEQ ID NO: 116
  derived and/or modified CDS sequence (AUadapt) from InfluenzaA__AFG31353__HA

SEQ ID NO: 8685 - RNA, 1701 nt, Artificial Sequence; identical to SEQ ID NO: 116
  derived and/or modified CDS sequence (AUadapt) from InfluenzaA__AFG31363__HA

SEQ ID NO: 8686 - RNA, 1701 nt, Artificial Sequence; identical to SEQ ID NO: 116
  derived and/or modified CDS sequence (AUadapt) from InfluenzaA__AFG31376__HA

SEQ ID NO: 8687 - RNA, 1701 nt, Artificial Sequence; identical to SEQ ID NO: 116
  derived and/or modified CDS sequence (AUadapt) from InfluenzaA__AFG31386__HA

SEQ ID NO: 8688 - RNA, 1701 nt, Artificial Sequence; identical to SEQ ID NO: 116
  derived and/or modified CDS sequence (AUadapt) from InfluenzaA__AFG31396__HA

SEQ ID NO: 8689 - RNA, 1701 nt, Artificial Sequence; identical to SEQ ID NO: 116
  derived and/or modified CDS sequence (AUadapt) from InfluenzaA__AFG31406__HA

SEQ ID NO: 8690 - RNA, 1701 nt, Artificial Sequence; identical to SEQ ID NO: 116
  derived and/or modified CDS sequence (AUadapt) from InfluenzaA__AFG31416__HA

SEQ ID NO: 8691 - RNA, 1701 nt, Artificial Sequence; identical to SEQ ID NO: 116
  derived and/or modified CDS sequence (AUadapt) from InfluenzaA__AFG31426__HA

SEQ ID NO: 8692 - RNA, 1701 nt, Artificial Sequence; identical to SEQ ID NO: 116
  derived and/or modified CDS sequence (AUadapt) from InfluenzaA__AFG31436__HA

SEQ ID NO: 8693 - RNA, 1701 nt, Artificial Sequence; identical to SEQ ID NO: 116
  derived and/or modified CDS sequence (AUadapt) from InfluenzaA__AFG31446__HA

SEQ ID NO: 8694 - RNA, 1701 nt, Artificial Sequence; identical to SEQ ID NO: 116
  derived and/or modified CDS sequence (AUadapt) from InfluenzaA__AFG31456__HA

SEQ ID NO: 8695 - RNA, 1701 nt, Artificial Sequence; identical to SEQ ID NO: 116
  derived and/or modified CDS sequence (AUadapt) from InfluenzaA__AFG31466__HA

SEQ ID NO: 8696 - RNA, 1701 nt, Artificial Sequence; identical to SEQ ID NO: 4016
  derived and/or modified CDS sequence (AUadapt) from InfluenzaA__AFG31486__HA

SEQ ID NO: 8697 - RNA, 1701 nt, Artificial Sequence; identical to SEQ ID NO: 116
  derived and/or modified CDS sequence (AUadapt) from InfluenzaA__AFG31496__HA

SEQ ID NO: 8698 - RNA, 1701 nt, Artificial Sequence; identical to SEQ ID NO: 116
  derived and/or modified CDS sequence (AUadapt) from InfluenzaA__AFG31506__HA

SEQ ID NO: 8699 - RNA, 1701 nt, Artificial Sequence; identical to SEQ ID NO: 116
  derived and/or modified CDS sequence (AUadapt) from InfluenzaA__AFG31516__HA

SEQ ID NO: 8700 - RNA, 1701 nt, Artificial Sequence; identical to SEQ ID NO: 3005
  derived and/or modified CDS sequence (AUadapt) from InfluenzaA__AFG31526__HA

SEQ ID NO: 8701 - RNA, 1701 nt, Artificial Sequence; identical to SEQ ID NO: 116
  derived and/or modified CDS sequence (AUadapt) from InfluenzaA__AFG31536__HA

SEQ ID NO: 8702 - RNA, 1701 nt, Artificial Sequence; identical to SEQ ID NO: 5469
  derived and/or modified CDS sequence (AUadapt) from InfluenzaA__AFG31546__HA

SEQ ID NO: 8703 - RNA, 1701 nt, Artificial Sequence; identical to SEQ ID NO: 5469
  derived and/or modified CDS sequence (AUadapt) from InfluenzaA__AFG31556__HA

SEQ ID NO: 8704 - RNA, 1701 nt, Artificial Sequence; identical to SEQ ID NO: 116
  derived and/or modified CDS sequence (AUadapt) from InfluenzaA__AFG31566__HA

SEQ ID NO: 8705 - RNA, 1701 nt, Artificial Sequence; identical to SEQ ID NO: 3156
  derived and/or modified CDS sequence (AUadapt) from InfluenzaA__AFG31586__HA

SEQ ID NO: 8706 - RNA, 1701 nt, Artificial Sequence; identical to SEQ ID NO: 3156
  derived and/or modified CDS sequence (AUadapt) from InfluenzaA__AFG31596__HA

SEQ ID NO: 8707 - RNA, 1701 nt, Artificial Sequence; identical to SEQ ID NO: 3156
  derived and/or modified CDS sequence (AUadapt) from InfluenzaA__AFG31606__HA

SEQ ID NO: 8708 - RNA, 1701 nt, Artificial Sequence; identical to SEQ ID NO: 3156
  derived and/or modified CDS sequence (AUadapt) from InfluenzaA__AFG31616__HA

SEQ ID NO: 8709 - RNA, 1701 nt, Artificial Sequence; identical to SEQ ID NO: 3156
  derived and/or modified CDS sequence (AUadapt) from InfluenzaA__AFG31626__HA

SEQ ID NO: 8710 - RNA, 1701 nt, Artificial Sequence; identical to SEQ ID NO: 116
  derived and/or modified CDS sequence (AUadapt) from InfluenzaA__AFG31636__HA

SEQ ID NO: 8711 - RNA, 1701 nt, Artificial Sequence; identical to SEQ ID NO: 116
  derived and/or modified CDS sequence (AUadapt) from InfluenzaA__AFG31646__HA

SEQ ID NO: 8712 - RNA, 1701 nt, Artificial Sequence; identical to SEQ ID NO: 4078
  derived and/or modified CDS sequence (AUadapt) from InfluenzaA__AFG31656__HA

SEQ ID NO: 8713 - RNA, 1701 nt, Artificial Sequence; identical to SEQ ID NO: 4078
  derived and/or modified CDS sequence (AUadapt) from InfluenzaA__AFG31666__HA

SEQ ID NO: 8714 - RNA, 1701 nt, Artificial Sequence
  derived and/or modified CDS sequence (AUadapt) from InfluenzaA__AFG71865__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcaucggcuucuucucgcgccucaacuggcugaccaaguccgggagcaccuaccccgugcugaacgucacgaugcccaacaacgacaacuucgacaagcucuacaucuggggcgugcaccacccguccaccaaccaggagcagaccucgcuguacgugcaggccuccgggcgggucaccgugagcacgcgccggucccagcagaccaucauccccaacaucggcucgcgccccugggugcggggccugagcucccgcaucucgaucuacuggaccaucgucaagcccggggacgugcucgugaucaacuccaacggcaaccugaucgcgccgcggggguacuucaagaugcgcaccggcaagagcuccaucaugcggucggacgcccccaucgacacgugcaucuccgagugcaucacccccaacgggagcauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucgagucgauccgcaacggcaccuacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 8715 - RNA, 1701 nt, Artificial Sequence; identical to SEQ ID NO: 1801
  derived and/or modified CDS sequence (AUadapt) from InfluenzaA__AFG71876__HA

SEQ ID NO: 8716 - RNA, 1701 nt, Artificial Sequence
  derived and/or modified CDS sequence (AUadapt) from InfluenzaA__AFG71898__HA
augaagaccaucaucgcccugucguaccucuucugccuggccuucggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaccaccgagggguucacguggaccggcgugacccagaacgggggcuccaacgccugcaagcgggggcccggcucgggcuucuucucccgccucaacuggcugaccaagagcggguccacguaccccgugcugaacgucaccaugucgaacaacgacaacuucgacaagcucuacaucuggggcgugcaccaccccuccaccaaccaggagcagaccagccuguacgugcaggccuccgggcgggucacggugucgacccgccggagccagcagaccaucaucccgaacaucggcucccgccccugggugcggggccugucgucccgcaucagcaucuacuggaccaucgucaagcccggggacgugcucgugaucaacuccaacggcaaccugaucgcgccccggggguacuucaagaugcgcacgggcaagucguccaucaugcggagcgacgccccgaucgacacgugcgucuccgagugcaucacccccaacgggucgauccccaacgacaagcccuuccagaacgugaacaagaucaccuacggcgccugcccgaaguacgugaagcagaacacccugaagcucgccaccggcaugcgcaacguccccgagaagcagacccgggggcuguucggcgccaucgcgggguucaucgagaacggcugggaggggaugaucgacggcugguacggcuuccgccaccagaacuccgaggggaccggccaggccgccgaccucaagagcacgcaggccgccaucgaccagaucaacgggaagcugaaccgggugaucgagaagaccaacgagaaguuccaccagaucgagaaggaguucuccgagguggagggccgcauccaggaccuggagaaguacgucgaggacaccaagaucgaccuguggucguacaacgcggagcuccugguggcccuggagaaccagcacaccaucgaccucacggacuccgagaugaacaagcuguucgagaagacccggcgccagcugcgggagaacgccgaggacauggggaacggcugcuucaagaucuaccacaagugcgacaacgccugcaucgagagcauccgcaacggcaccuacgaccacgacgucuaccgcgacgaggcccucaacaaccgguuccagaucaaggggguggagcugaaguccggcuacaaggacuggauccuguggaucagcuucgcgaucuccugcuuccuccugugcgugguccugcucggguucaucaugugggccugccagcgcggcaacauccggugcaacaucugcaucuga

SEQ ID NO: 8717 - RNA, 1701 nt, Artificial Sequence
  derived and/or modified CDS sequence (AUadapt) from InfluenzaA__AFG71920__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagucguccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucucgaacugcuaccccuacgacgugccggacuacgcgucccuccgcagccugaucgccuccucgggcacccuggaguucaucaccgagggguucaccuggacgggcgucacccagaacgggggcuccaacgccugcaagcgggggcccggcagcggcuucuucucccgccucaacuggcugaccaagucgggguccaccuaccccgugcugaacgugacgaugcccaacaacgacaacuucgacaagcucuacaucuggggcguccaccacccgagcaccaaccaggagcagaccucccuguacgugcaggccucggggcgggugaccgucuccacgcgccggagccagcagaccaucauccccaacaucggcucgcgccccugggugcggggccuguccagccgcaucuccaucuacuggaccaucgugaagcccggggacguccucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucucggaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagucgggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 8718 - RNA, 1701 nt, Artificial Sequence
  derived and/or modified CDS sequence (AUadapt) from InfluenzaA__AFG71931__HA
augaagaccaucaucgcccugucguacaucuucugccucgugaucggccaggaccugcccgggaacgagaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaccgagggcuucaccuggacgggggugacccagaacggcggguccaacgccugcaagcggggccccggcaucggguucuucucgcgccugaacuggcucaccaaguccggcagcaccuaccccgugcugaacgucacgaugcccaacaacgacaacuucgacaagcuguacaucuggggcgugcaccacccguccaccaaccaggagcagaccucgcucuacgugcaggccuccgggcgggucaccgugagcacgcgccggucccagcagaccaucauccccaacaucggcucgcgccccugggugcgggggcugagcucccgcaucucgaucuacuggaccaucgucaagcccggcgacgugcuggugaucaacuccaacgggaaccucaucgccccgcggggcuacuucaagaugcgcaccggcaagagcuccaucaugcggucggacgcgcccaucgacacgugcaucuccgagugcaucacccccaacgggagcauccccaacgacaagccguuccagaacgucaacaagaucaccuacggcgccugccccaaguacgugaagcagaacacccugaagcuggccacggggaugcgcaacgugcccgagaagcagacccggggccucuucggggccaucgccggcuucaucgagaacgggugggagggcaugaucgacggcugguacggguuccgccaccagaacuccgagggcaccgggcaggcggccgaccucaagucgacccaggccgccaucgaccagaucaacggcaagcugaaccgggucaucgagaagacgaacgagaaguuccaccagaucgagaaggaguucuccgagguggaggggcgcauccaggaccucgagaaguacguggaggacaccaagaucgaccuguggagcuacaacgccgagcugcucgucgcgcuggagaaccagcacaccaucgaccugaccgacuccgagaugaacaagcuguucgagaagacgcggcgccagcugcgggagaacgccgaggacaugggcaacggcugcuucaagaucuaccacaagugcgacaacgccugcaucgagucgauccgcaacgggaccuacgaccacgacguguaccgcgacgaggcccugaacaaccgguuccagaucaagggcgucgagcucaaguccggguacaaggacuggauccuguggaucagcuucgccaucuccugcuuccugcucugcguggugcugcugggcuucaucaugugggcgugccagcgcggcaacauccggugcaacaucugcaucuga

SEQ ID NO: 8719 - RNA, 1701 nt, Artificial Sequence
  derived and/or modified CDS sequence (AUadapt) from InfluenzaA__AFG71942__HA
augaagaccaucaucgcccugucguacaucuucuaccucgcccugucccaggaccugcccggcaacgacaacucgaaggcgacccucugccuggggcaccacgccgugccgaacggcacgcuggucaagaccaucaccgacgaccagaccgaggugacgaacgccaccgagcucgugcaguccagcuccaccgggaagaucugcaacaacccccaccgcauccuggacggcauggacugcacccugaucgacgcccuccugggggacccccacugcgacgucuuccagaacgagacgugggaccuguucguggagcggucgaaggccuucuccaacugcuaccccuacgacgugccggacuacgcgagccuccgcucccuggucgccucguccggcacccuggaguucaucaccgagggcuucaccuggacggaggugacccagaacgggggcagcaucgccugcaagcgggggcccgacuccggcuucuucucgcgccucaacuggcugaccaaguccgggcggaccuaccccgugcugaacgucacgaugcccaacaacgacaacuucgacaagcucuacaucuggggcgugcaccacccgagcaccgaccaggagcagaccaaccuguacgugcagaccuccggccgcgucacggugucgacccggcgcucccagcagaccaucauccccaacaucgggucgcggcccugggugcgcggccugagcucccggaucucgaucuacuggaccaucgucaagcccggggacgugcucgugaucaacuccaacggcaaccugaucgccccgcgcggcuacuucaagaugcggacgggcaagagcuccaucaugcgcucggacgcgcccaucgacacgugcaucuccgagugcaucacccccaacgggagcauccccaacgacaagccguuccagaacgucaacaagaucaccuacggggccugccccaaguacgugaagcagaacacccugaagcucgccaccggcaugcggaacgugcccgagaagcagacccgcgggcuguucggcgccaucgccggcuucaucgagaacgggugggagggcaugaucgacgggugguacggcuuccggcaccagaacuccgaggggaccggccaggcggccgaccucaagucgacgcaggccgccaucgaccagaucaacggcaagcugaaccgcaucaucgagaagaccaacgagaaguuccaccagaucgagaaggaguucuccgaggucgaggggcggauccaggaccuggagaaguacguggaggacaccaagaucgaccuguggagcuacaacgccgagcuccugguggcgcuggagaaccagcacaccaucgaccucacggacuccgagaugaacaagcuguucgagaagacccgccggcagcugcgcgagaacgccgaggacaugggcaacgggugcuucaagaucuaccacaagugcgacaacgccugcaucgagucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggcuucaucaugugggcgugccagcgggggaacauccgcugcaacaucugcaucuga

SEQ ID NO: 8720 - RNA, 1701 nt, Artificial Sequence
  derived and/or modified CDS sequence (AUadapt) from InfluenzaA__AFG71953__HA
augaagaccaucaucgcccugucguacaucuucugccucgugcugggccaggaccugcccgggaacgacaaguccaccgccacgcucugccugggccaccacgcggucccgaacgggacccuggugaagaccaucaccaacgaccagaucgaggugacgaacgccaccgagcucguccagucguccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucucgaacugcuaccccuacgacgugccggacuacgccucccuccgcucgcuggucgcguccagcgggacccuggaguucaucaccgagggcuucaccuggacgggggugacccagaacggcggguccaacgccugcaagcggggccccggcucgggguucuucucccgccucaacuggcugaccaagucgggcuccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgaagcgcucgcagcagaccaucauccccaacaucggcagccggcccugggugcgcgggcccuccucgcggaucuccaucuacuggaccaccgucaagccgggcgacauccugaucaucaacucgaacgggaaccucaucgcgccccgcggcuacuucaagaugcggacggggaaguccagcaucaugcgcuccgacgcccccaucggcgccugcaucucggagugcaucacccccaacggcuccaucccgaacgacaagcccuuccagaacgugaacaagaucaccuacggggccugccccaaguacgugaagcagaacacccugaagcuggccacgggcaugcggaacguccccgagaagcagacccgcggccucuucggggccaucgcgggguucaucgagaacggcugggagggcaugaucgacgggugguacggcuuccggcaccagaacucggaggggaccggccaggccgccgaccugaaguccacccaggccgccaucgaccagaucaacgggaagcugaaccgcgugaucgagaagacgaacgagaaguuccaccagaucgagaaggaguucagcgagguggagggccggauccaggaccucgagaaguacgucgaggacaccaagaucgaccugugguccuacaacgcggagcugcucguggcccuggagaaccagcacaccaucgaccugaccgacucggagaugaacaagcuguucgagaagacgcgccggcagcuccgcgagaacgccgaggacaugggcaacgggugcuucaagaucuaccacaagugcgacaacgccugcaucggcuccauccggaacgggaccuacgaccacgacguguaccgcgacgaggcccugaacaaccgcuuccagaucaagggcgucgagcucaagucgggcuacaaggacuggauccuguggaucuccuucgcgaucagcugcuuccugcucugcgugguccugcugggggugaucaugugggccugccagaagggcaacauccggugcaacaucugcaucuga

SEQ ID NO: 8721 - RNA, 1701 nt, Artificial Sequence; identical to SEQ ID NO: 550
  derived and/or modified CDS sequence (AUadapt) from InfluenzaA__AFG71975__HA

SEQ ID NO: 8722 - RNA, 1701 nt, Artificial Sequence
  derived and/or modified CDS sequence (AUadapt) from InfluenzaA__AFG71996__HA
augaagaccaucaucgcccugucguacaucuucugccucgugcugggccagaacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccucggggacccuggaguucaucaacgagggcuucaccuggaccggggugacgcagaacggcggguccaacgccugcaagcggggccccgacaucggcuucuucagccgccugaacuggcucuacaaguccgggaacaccuaccccgugcugaacgucucgaugcccaacaacgacaacuucgacaagcuguacaucuggggcgugcaccacccguccaccgaccaggagcagaccagccucuacgugcaggccuccgggcgggucacggugagcaccaagcgcucccagcagaccaucauccccaacaucggcucgcggcccugggugcgcggccugagcucccggaucagcaucuacuggaccaucgucaagcccggggacauccuggugaucaacuccaacggcaaccucaucgccccgcgcggguacuucaagaugcggacgggcaagucguccaucaugcgcagcgacgcguccaucgggaccugcaucucggagugcaucacccccaacggcuccauccccaacgacaagcccuuccagaacgugaacaagaucaccuacggcgccugcccgaaguacgucaagcagaacacgcugaagcuggccaccgggaugcggaacgugcccgagaagcagacccgcggcaucuucggggccaucgccggcuucaucgagaacgggugggagggcaugaucgacggcugguacggguuccggcaccagaacagcgagggcaccgggcaggcggccgaccucaaguccacgcaggccgccaucgaccagaucaacggcaagcugaaccgcaucaucgagaagaccaacgagaaguuccaccagaucgagaaggaguucagcgagguggaggggcggauccaggaccuggagaaguacgucgaggacaccaagaucgaccucugguccuacaacgccgagcugcugguggcgcucgagaaccagcacaccaucgaccugacggacucggagaugaacaagcuguucgagaagacccgccggcagcuccgcgagaacgccgaggacaugggcaacggcugcuucaagaucuaccacaagugcgacaacgccugcaucggguccauccggaacggcaccuacgaccacgacguguaccgcgacgaggcccugaacaaccgcuuccagaucaagggggucgagcucaagagcggcuacaaggacuggauccuguggaucuccuucgccaucagcugcuuccugcugugcgugguccuccugggcuucaucaugugggcgugccagaaggggaacauccggugcaacaucugcaucuga

SEQ ID NO: 8723 - RNA, 1701 nt, Artificial Sequence
  derived and/or modified CDS sequence (AUadapt) from InfluenzaA__AFG72007__HA
augaagaccaucaucgcccugucguacaucuucugccucgugcugggccgcgacuucccccggaacgacaacuccaccgccacgcugugccucgggcaccacgcggucccgaacggcacccuggugaagaccaucaccaacgaccagaucgaggugacgaacgccaccgagcugguccagucguccagcaccgggaagaucugcaacaacccccaccgcauccucgacggcauggacugcacccugaucgacgcccugcucggggacccccacugcgacggccugcagaacggcacgugggaccuguucguggagcgguccaaggccuucucgaacugcuaccccuacgacgugccggacuacgccucccuccgcagccuggucgcguccucggggacccuggaguucaucaacgagggcuucaccuggaccggggugacgcagaacggcggguccaacgccugcaagcggggccccgacagcggcuucuucucccgccucaacuggcuguacaagucggggaacaccuaccccgugcugaacgucaccaugcccaacaacgacaacuucgacaagcucuacaucuggggcgugcaccacccguccaccgaccaggaccagacgagccuguacgugcaggccuccgggcgggucaccgugucgaccaagcgcucccagcagaccgugauccccaacaucggcccccggcccuggguccgcggccugucgagccggaucuccaucuacuggacgaucgugaagccgggggacauccuccugaucaacucgaacggcaaccugaucgcgccccgcggguacuucaagaugcggaccggcaaguccagcaucaugcgcuccgacgcccccaucgggaccugcaucucggagugcaucacccccaacggcuccaucccgaacgacaagcccuuccagaacgugaacaagaucacguacggcgccugccccaaguacgucaagcagaacacccucaagcuggccaccgggaugcggaacgugcccgagaagcagacccgcggcaucuucggggccaucgccggcuucaucgagaacgggugggagggcaugaucgacggcugguacggguuccggcaccagaacagcgagggcacggggcaggcggccgaccugaaguccacccaggccgccaucgaccagaucaacggcaagcucaaccgcgugaucgagaagaccaacgagaaguuccaccagaucgagaaggaguucucggaggucgaggggcggauccaggaccuggagaaguacguggaggacaccaagaucgaccugugguccuacaacgccgagcuccugguggcgcuggagaaccagcacacgaucgaccucaccgacagcgagaugaacaagcuguucgagaagacccgccggcagcugcgcgagaacgccgaggacaugggcaacggcugcuucaagaucuaccaccgcugcgacaacgccugcaucggguccauccggaacggcaccuacgaccacgacgucuaccgcgacgaggcccucaacaaccgguuccagaucaaggggguggagcucaagucgggcuacaaggacuggauccuguggaucuccuucgccaucagcugcuuccugcugugcgucgugcugcucggcuucaucaugugggcgugccagaaggggaacauccgcugcaacaucugcaucuga

SEQ ID NO: 8724 - RNA, 1701 nt, Artificial Sequence
  derived and/or modified CDS sequence (AUadapt) from InfluenzaA__AFG72029__HA
augaagaccaucaucgcccugucguacaucuucugccucguguucggccagaaccugcccgggaacgacaacuccaccgccacgcugugccucggccaccacgcggucccgaacgggacccuggugaagaccaucaccaacgaccagaucgaggugacgaacgccaccgagcugguccagagcuccucgaccggccgcaucugcgacagcccccaccggauccucgacgggaagaacugcacccugaucgacgcccugcucggcgacccccacugcgacggcuuccagaacgagaagugggaccuguucguggagcgcuccaaggccuucuccaacugcuaccccuacgacgugccggacuacgccagccugcggucccucaucgcgucguccgggacgcuggaguucaucaacgagggcuucaacuggaccggggucacccagagcggcggguccuacgccugcaagcgcggcucggacaacuccuucuucagccggcugaacuggcucuacgaguccgagagcaaguaccccgugcugaacgugaccaugcccaacaacggcaacuucgacaagcuguacaucuggggcguccaccaccccuccacggacaaggagcagaccaaccucuacgugcgcgccucgggccgggugaccgucagcaccaagcgcucccagcagacgaucaucccgaacaucgggucgcggcccugggugcgcggccuguccagccggaucuccaucuacuggaccaucgugaagcccggcgacauccugcucaucaacagcaacgggaaccugaucgcgccccgcggcuacuucaagauccggaccgggaaguccucgaucaugcgcuccgacgccccgaucgggaccugcagcuccgagugcaucacgcccaacgggucgauccccaacgacaagcccuuccagaacgucaacaagaucaccuacggcgccugcccgaaguacgugaagcagaacacccugaagcucgccaccggcaugcggaacgugcccgagaagcagacgcgcgggaucuucggcgccaucgccggguucaucgagaacggcugggaggggauggucgacggcugguacggcuuccggcaccagaacuccgaggggaccggccaggcggccgaccucaagagcacccaggccgccaucgaccagaucaacgggaagcugaaccgcgugaucgagaagaccaacgagaaguuccaccagaucgagaaggaguucuccgagguggagggccggauccaggaccucgagaaguacgucgaggacacgaagaucgaccuguggagcuacaacgccgagcugcucguggcgcuggagaaccagcacaccaucgaccugaccgacuccgagaugaacaagcuguucgagaagacccgccggcagcugcgcgagaacgccgaggacauggggaacggcugcuucaagaucuaccacaagugcgacaacgccugcaucggcucgauccgcaacgggacguacgaccacgacguguaccgggacgaggcccugaacaaccgcuuccagaucaagggcgucgagcucaaguccggguacaaggacuggauccuguggaucagcuucgccaucagcugcuuccugcucugcgugguccugcugggcuucaucaugugggcgugccagaagggcaacauccggugcaacaucugcaucuga

SEQ ID NO: 8725 - RNA, 1701 nt, Artificial Sequence
  derived and/or modified CDS sequence (AUadapt) from InfluenzaA__AFG72040__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccucguccggcacgcuggaguucaucaacgagagcuucaacuggaccggggugacccaguccggcgggagcuacgccugcaagcgcggcuccgacaacucguucuucucccggcugaacuggcucuacgagagcgaguccaaguaccccguccugaacgugaccaugcccaacaacgggaacuucgacaagcuguacaucuggggcgugcaccaccccagcacggacaaggagcagaccaaccucuacguccgcgccucgggccgggugaccguguccaccaagcgcagccagcagacgaucaucccgaacaucgggucccggcccuggguccgcggccugagcucccggaucucgaucuacuggaccaucgugaagcccggggacauccugcucaucaacuccaacggcaaccugaucgcgccccgcggcuacuucaagauccggaccggcaagagcuccaucaugcgcagcgacgccccgaucgggaccugcuccucggagugcaucacgcccaacggguccauccccaacgacaagcccuuccagaacgugaacaagaucaccuacggcgccugcccgaaguacgucaagcagaacacccugaagcucgccaccgggaugcggaacgugcccgagaagcagacgcgcggcaucuucggcgccaucgcgggguucaucgagaacggcugggaggggaugguggacggcugguacggguuccggcaccagaacagcgagggcaccggccaggccgccgaccugaaguccacccaggccgccaucgaccagaucaacgggaagcugaaccgcgucaucgagaagaccaacgagaaguuccaccagaucgagaaggaguucagcgagguggagggccggauccaggaccucgagaaguacguggagaacacgaagaucgaccugugguccuacaacgcggagcugcucgucgcccuggagaaccagcacaccaucgaccugaccgacucggagaugaacaagcuguucgagaagacccgccggcagcuccgcgagaacgccgaggacauggggaacggcugcuucaagaucuaccacaagugcgacaacgccugcaucggguccauccgcaacggcacguacgaccacgacguguaccgggacgaggcccugaacaaccgcuuccagaucaagggcgucgagcucaagagcggguacaaggacuggauccuguggaucagcuucgcgaucuccugcuuccugcucugcguggugcugcugggcuucaucaugugggccugccagaaggggaacauccggugcaacaucugcaucuga

SEQ ID NO: 8726 - RNA, 1701 nt, Artificial Sequence
  derived and/or modified CDS sequence (AUadapt) from InfluenzaA__AFG72051__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccucguccggcacgcuggaguucaucaacgagagcuucaacuggaccggggugacccaguccggcgggucguacgccugcaagcgcggcuccgacaacagcuucuucucccggcugaacuggcucuacgagagcgaguccaaguaccccguccugaacgugaccaugcccaacaacgggaacuucgacaagcuguacaucuggggcgugcaccaccccucgacggacaaggagcagaccaaccucuacguccgcgccagcggccgggugaccguguccaccaagcgcaaccagcagacggucaucccgaacaucgggucgcggcccugggugcgcggccuguccagccggaucuccaucuacuggaccaucgugaagcccggggacauccugcucaucaacagcaacggcaaccugaucgcgccccgcggcuacuucaagauccacaacgggaaguccucgaucaugcgguccgacgccccgaucgggaccugcagcuccgagugcaucacccccaacggcucgauccccaacgacaagcccuuccagaacgucaacaagaucacguacggcgccugcccgaaguacgugaagcagaacacccugaagcucgccaccgggaugcgcaacgugcccgagaagcagacccggggcaucuucggcgccaucgcgggguucaucgagaacggcugggaggggauggucgacggcugguacggguuccgccaccggaacuccgagggcacgggccaggccgccgaccucaagagcacccaggccgccaucgaccagaucaacgggaagcugaaccgcgugaucgagaagaccaacgagaaguuccaccagaucgagaaggaguucuccgagguggagggccggauccaggaccucgagaaguacgucgaggacaccaagaucgaccuguggagcuacaacgcggagcugcucguggcccuggagaaccagcacacgaucgaccugaccgacuccgagaugaacaagcuguucgagaagacccgccggcagcugcgcgagaacgccgaggacauggggaacggcugcuucaagaucuaccacaagugcgacaacgccugcaucgggucgauccgcaacggcaccuacgaccacgacgucuaccgggacgaggcccugaacaaccgcuuccagaucaagggcguggagcucaaguccggguacaaggacuggauccuguggaucagcuucgcgaucagcugcuuccugcucugcgugguccugcugggcuucaucaugugggccugccagaaggggaacauccggugcaacaucugcaucuga

SEQ ID NO: 8727 - RNA, 1701 nt, Artificial Sequence
  derived and/or modified CDS sequence (AUadapt) from InfluenzaA__AFG72085__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccagcuccggcacgcuggaguucaucaacgaggacuucaacuggaucggggugacccagucgggcggguccugcgccugcaagcgcggcagcgugaacuccuucuucucgcggcugaacuggcuccacgaguccgagcagaaguaccccgcccugaacgucaccaugcccaacaacgggaaguucgacaagcuguacaucuggggcgugcaccaccccagcaccgaccgcgagcagacgaaccucuacgugcgggcguccggccgcgucaccgugagcaccaagcggucgcagcagaccgugaucccgaacaucgggucccgccccuggguccggggccugagcucccgcaucucgaucuacuggacgaucgugaagcccggggacauccugcucaucaacuccaucggcaaccugaucgcgccccggggcuacuucaagauccgcaccggcaagagcuccaucaugcggagcgacgccccgaucgggaccugcuccucggagugcaucacccccaacggguccauccccaacgacaagcccuuccagaacgugaacaagaucacguacggcgccugcccgcgcuacgucaagcagaacacccugaagcucgccaccgggaugcggaacgugcccgagaagcagacccgcggcaucuucggcgccaucgccggguucaucgagaacggcugggaggggaugguggacggcugguacggguuccggcaccagaacagcgagggcacgggccaggccgccgaccugaaguccacccaggccgcgaucgaccagaucaacgggaagcugaaccgccucaucgagaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagacccgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 8728 - RNA, 1701 nt, Artificial Sequence
  derived and/or modified CDS sequence (AUadapt) from InfluenzaA__AFG72107__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuucuccaacugcuaccccuacgacgugccggacuacgcgagccugcggucccucaucgccucguccggcacgcuggaguucaucaacgaggaguucaacuggaccggggucacccagaacggcgggagcuacgccugcaagcgcggcuccgugaacucguucuucucccggcugaacuggcuccacgagagcgaguacaaguaccccgcccugaacgugaccaugcccaacaacgggcgcuucgacaagcuguacaucuggggcguccaccaccccuccacggaccgggagcagaccaaccucuacgugcgcgcgucgggccgggugaccgucuccaccaagcgcagccagcagacggugaucccgaacaucgggccccggcccugggugcgcggccugucgucccggaucagcaucuacuggaccaucgucaagcccggggacauccugcucaucaacuccaccggcaaccugaucgccccgcgcggcuacuucaagauccacaccgggaaguccuccaucaugcggucggacgcccccaucggcacgugcuccagcgagugcaucacccccaacggguccauccccaacgacaagccguuccagaacgugaacaagaucaccuacggcgccugcccccgcuacgugaagcagaacacccugaagcucgccacggggaugcggaacguccccgagaagcagacccgcggcaucuucggcgcgaucgccggguucaucgagaacggcugggaggggaugguggacggcugguacggguuccggcaccagaacucggagggcaccggccaggccgccgaccugaaguccacccaggccgcgaucgaccagaucaacgggaagcugaaccgccucaucgagaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacguguaccgcgacgaggcggucaacaaccgguuccagaucaagggcguggagcucaagagcggguacaaggacuggauccuguggaucuccuucgccaucagcugcuuccugcucugcgucauccugcugggcuucaucaugugggccugccagaaggggaacauccgcugcaacaucugcaucuga

SEQ ID NO: 8729 - RNA, 1701 nt, Artificial Sequence
  derived and/or modified CDS sequence (AUadapt) from InfluenzaA__AFG72118__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagaacagcuccaccgggcgcaucugcaacucgccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaucaacgaggacuucaacuggaccgggguggcccaguccggcgggucguacgccugcaagcgcggcuccgugaacagcuucuucucccggcugaacuggcuccacgagucggaguacaaguaccccgcgcugaacgucaccaugcccaacaacgggaaguucgacaagcuguacaucuggggcgugcaccaccccuccaccgaccgcgagcagacgaaccucuacgugcgggccagcggccgcgucaccguguccaccaagcggucgcagcagaccgugaucccgaacaucgggagccgccccuggguccggggccuguccucgcgcaucuccaucuacuggacgaucgugaagcccggggacauccugcucaucaacagcaccggcaaccugaucgcgccccggggcuacuucaagauccgcaccgggaaguccucgaucaugcgguccgacgccccgaucgggaccugcagcuccgagugcaucacgcccaacggcucgauccccaacgacaagcccuuccagaacgugaaccgcaucaccuacggcgccugcccgcgguacgucaagcagaacacccugaagcucgccaccgggaugcgcaacgugcccgagcggcagacgcgcggcaucuucggcgccaucgccggguucaucgagaacggcugggaggggaugguggacggcugguacggguuccggcaccagaacuccgagggcaccggccaggccgccgaccucaagagcacccaggcggccaucgaccagaucaacgggaagcugaaccgccugaucgagaagaccaacgagaaguuccaccagaucgagaaggaguucuccgaggucgagggccgcauccaggaccuggagaaguacguggaggacacgaagaucgaccuguggucguacaacgccgagcuccugguggcccuggagaaccagcacaccaucgaccucaccgacuccgagaugaacaagcuguucgagaagacccggaagcagcugcgcgagaacgccgaggacauggggaacggcugcuucaagaucuaccacaagugcgacaacgcgugcaucgggagcauccggaacggcacguacaaccacgacgucuaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggccugccagaaggggaacauccgcugcaacaucugcaucuga

SEQ ID NO: 8730 - RNA, 1701 nt, Artificial Sequence
  derived and/or modified CDS sequence (AUadapt) from InfluenzaA__AFG72129__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugucgaccaagcggagccagcagaccgugaucccgaacaucgggucccgccccuggguccggggccugucguccgggaucagcaucuacuggacgaucgugaagcccggcgacauccugcucaucaacuccaccggcaaccugaucgcgccccgcggguacuucaagauccggaccggcaagucguccaucaugcgcagcgacgccccgaucgggaccugcuccucggagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcggcaucuucggggccaucgccggcuucaucgagaacgggugggagggcaugguggacgggugguacggcuuccggcaccagaacagcgagggcaccgggcaggccgccgaccugaaguccacccaggcggccaucaaccagaucaacggcaagcugaaccgccucaucgagaagaccaacgagaaguuccaccagaucgagaaggaguucucggaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgcgagaacgccgaggacaugggcaacgggugcuucaagaucuaccacaagugcgacaacgcgugcaucggcuccauccggaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcgucgugcugcucggguucaucaugugggccugccagaagggcaacauccgcugcaacaucugcaucuga

SEQ ID NO: 8731 - RNA, 1701 nt, Artificial Sequence
  derived and/or modified CDS sequence (AUadapt) from InfluenzaA__AFG72140__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccagcuccggcacgcuggaguucaucaacgaggacuucaacuggaccgggguggcccagucgggcggguccuacgccugcaagcgcggcagcgugaacuccuucuucucgcggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggcccugggccgcgucaccguguccaccaagcggucgcagcagaccgugaucccgaacaucgggagccgccccuggguccggggccuguccagccgcaucuccaucuacuggacgaucgugaagcccggggacauccuccugaucaacucgaccggcaaccugaucgcgccccggggcuacuucaagauccgcaccgggaaguccagcaucaugcgguccgacgccccgaucgggaccugcucguccgagugcaucacgcccaacggcagcauccccaacaacaagcccuuccagaacgugaaccgcaucaccuacggcgccugcccgcgguacgucaagcagaacacccucaagcuggccaccgggaugcgcaacgugcccgagaagcagacgcggggcaucuucggcgccaucgccggguucaucgagaacggcugggaggggaugguggacggcugguacggguuccgccaccagaacuccgagggcaccggccaggccgccgaccugaaguccacccaggcggccaucgaccagaucaacgggaagcucaaccggcugaucgagaagaccaacgagaaguuccaccagaucgagaaggaguucuccgaggucgagggccgcauccaggaccuggagaaguacguggaggacacgaagaucgaccucuggucguacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgcgugcaucgggagcauccgcaacggcacguacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaaggggaacauccggugcaacaucugcaucuga

SEQ ID NO: 8732 - RNA, 1701 nt, Artificial Sequence
  derived and/or modified CDS sequence (AUadapt) from InfluenzaA__AFG72151__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccagucgggcgaguccuacgccugcaagcgcgggagcgugaaguccuucuucucgcggcucaacuggcugcacgaguccgacuacaaguaccccgcgcugaacgucaccaugcccaacaacggcaaguucgacaagcucuacaucuggggcgugcaccaccccagcacggaccgcgagcagaccucccuguacgugcgggccucggggcgcgucaccgugagcaccaagcggucccagcagacggugaucccgaacaucggcucgcgccccuggguccgggggcuguccagccgcaucuccaucuacuggaccaucgugaagcccggcgacauccuccugaucaacucgaccgggaaccugaucgcgccccggggcuacuucaagauccgcaccggcaaguccagcaucaugcgguccgacgccccgaucgggacgugcucguccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggucguacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcugaaguccggcuacaaggacuggauccucuggaucucguucgccaucagcugcuuccugcugugcgucgugcuccugggguucaucaugugggccugccagaagggcaacauccggugcaacaucugcaucuga

SEQ ID NO: 8733 - RNA, 1701 nt, Artificial Sequence
  derived and/or modified CDS sequence (AUadapt) from InfluenzaA__AFG72184__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacgacuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccggcguggcccagagcggggaguccuacgccugcaagcgcggcucggugaaguccuucuucagccggcucaacuggcugcacgaguccgaguacaaguaccccgcgcugaacgucaccaugcccaacaacgacaaguucgacaagcucuacaucuggggcgugcaccaccccucgaccgagcgcgagcagacgucccuguacauccgggccagcggccgcgugaccgucucgaccaagcggucccagcagaccgugaucccgaacaucgggagccgccccugggugcggggccuguccucgcgcaucuccaucuacuggacgaucgucaagcccggcgacauccuccugaucaacagcaccgggaaccugaucgcgccccggggcuacuucaagauccgcaccgggaaguccucgaucaugcgguccgacgccccgaucgggaccugcagcuccgagugcaucacgcccaacggcucgauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccugaaguccacccaggcggccaucgaccagaucaacgggaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 8734 - RNA, 1701 nt, Artificial Sequence; identical to SEQ ID NO: 8732
  derived and/or modified CDS sequence (AUadapt) from InfluenzaA__AFG72195__HA

SEQ ID NO: 8735 - RNA, 1701 nt, Artificial Sequence
  derived and/or modified CDS sequence (AUadapt) from InfluenzaA__AFG72206__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggaagaucugcgacagcccccaccgcauccuggacggcaagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaucaacgaggacuucaacuggaccgggguggcccagagcggcgaguccuacgccugcaagcgggggucggugaaguccuucuucagccgccucaacuggcugcacgaguccgacuacaaguaccccgcgcugaacgucaccaugcccaacaacggcaaguucgacaagcucuacaucuggggcgugcaccaccccucgaccgaccgggagcagacgucccuguacauccgcgccagcgggcgggugaccgucucgaccaagcgcucccagcagaccgugaucccgaacaucggcagccggcccugggugcgcgggcuguccucgcggaucuccaucuacuggacgaucgucaagcccggcgacauccuccugaucaacagcaccgggaaccugaucgcgccccgcggcuacuucaagauccggaccggcaaguccucgaucaugcgcuccgacgccccgaucgggaccugcagcuccgagugcaucacgcccaacggcucgauccccaacgacaagcccuuccagaacgugaaccggaucaccuacggggccugcccgcgcuacgugaagcagaacacccucaagcuggccaccggcaugcggaacguccccgagaagcagacgcgcgggaucuucggcgccaucgccggcuucaucgagaacgggugggagggcaugguggacgggugguacggcuuccggcaccagaacuccgaggggaccggccaggccgccgaccugaaguccacccaggcggccaucgaccagaucaacggcaagcucaaccgccugaucgagaagaccaacgagaaguuccaccagaucgagaaggaguucuccgagguggaggggcggauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgcgagaacgccgaggacaugggcaacgggugcuucaagaucuaccacaagugcgacaacgcgugcaucggcucgauccggaacgggacguacgaccacgacguguaccgcgacgaggcccugaacaaccgguuccagaucaagggcgucgagcugaaguccggcuacaaggacuggauccucuggaucagcuucgccaucagcugcuuccugcugugcgugguccuccugggguucaucaugugggccugccagaagggcaacauccgcugcaacaucugcaucuga

SEQ ID NO: 8736 - RNA, 1701 nt, Artificial Sequence
  derived and/or modified CDS sequence (AUadapt) from InfluenzaA__AFG72217__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccucgaccgacuccgaccagacgagccuguacgugcgcgccuccggccgggucaccgugucgaccaagcgcagccagcagaccgugacgccgaacaucgggucccggcccuggguccgcggccucucgucccggaucagcaucuacuggaccaucgugaagcccggggacauccugcugaucuccucgaccggcaaccucaucgcgccccgcggcuacuucaagauccggaacgggaaguccagcaucaugcgcuccgacgccccgaucggcaacugcucguccgagugcaucacccccaacgggagcauccccaacgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgccggguucaucgagaacggcugggaggggaugguggacggcugguacggguuccggcaccagaacuccgagggcacgggccaggccgccgacaucaagucgacccaggcggccaucgaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagacccgcaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgguuccagaucaagggcguggagcugaaguccggguacaaggaccucauccuguggaucagcuucgccaucagcugcuuccugcucugcgucgugcugcugggcuucaucaugugggccugccagaaggggaacauccgcugcaacaucugcaucuga

SEQ ID NO: 8737 - RNA, 1701 nt, Artificial Sequence
  derived and/or modified CDS sequence (AUadapt) from InfluenzaA__AFG72228__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccagucgggcgaguccuacgccugcaagcgcgggagcgugaaguccuucuucucgcggcucaacuggcugcacgaguccgacuacaaguaccccgagcugaacgucaccaugcccaacaacggcaaguucgacaagcucuacaucuggggcgugcaccaccccagcacggaccgcgagcagaccucccuguacgugcgggcgucggggcgcgucaccgugagcaccaagcggucccagcagacggugaucccgaacaucggcucgcgccccuggguccgggggcuguccagccgcaucuccaucuacuggaccaucgugaagcccggcgacauccuccugaucaacucgaccgggaaccugaucgcgccccggggcuacuucaagauccgcaccggcaaguccagcaucaugcgguccgacgccccgaucgggacgugcucguccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggccgcgaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggucguacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgccugcaucggcagcauccgcaacgggaccuacgaccacgacgucuaccgggacgaggcgcugaacaaccgcuuccagaucaagggcguggagcugaaguccggcuacaaggacuggauccucuggaucucguucgccaucagcugcuuccugcugugcgucgugcuccugggguucaucaugugggccugccagaagggcaacauccggugcaacaucugcaucuga

SEQ ID NO: 8738 - RNA, 1701 nt, Artificial Sequence
  derived and/or modified CDS sequence (AUadapt) from InfluenzaA__AFG72239__HA
augaagaccaucaucgcccugucguacauccucugccuggugcuggcccagaagcuccccggcuccgacaacucgaccgcgacgcugugccuggggcaccacgccgucccgaacggcacccucgugaagaccaucaccaacgaccagaucgaggugacgaacgccaccgagcugguccaguccagcaccaccgggcgcaucugcgacucgccccaccggauccuggacggcaagaacugcacgcucaucgacgcccugcugggggacccccacugcgacggcuuccagaacaaggagugggaccucuucguggagcgcuccaaggccuacuccaacugcuaccccuacgacgugccggacuacgcgagccugcggucccuggucgccucguccggcacccucgaguucaccaacgaggacuucaacuggaccgggguggcccagagcggcgaguccuacgccugcaagcgcgggucggugaaguccuucuucucgcggcugaacuggcugcacgaguccgacuacaaguaccccgcgcucaacgucacgaugcccaacaacggcaaguucgacaagcuguacaucuggggcgugcaccaccccagcaccgaccgcgagcagaccucccuguacgugcgggccucggggcgcgucaccgugagcacgaagcggucccagcagaccgugaucccgaacaucggcucgcgccccuggguccgggggcucuccagccgcaucuccaucuacuggaccaucgugaagcccggcgacauccugcugaucaacucgaccgggaaccucaucgcgccccggggcuacuucaagauccgcacgggcaaguccucgaucaugcgguccgacgccccgaucgggaccugcagcuccgagugcaucacccccaacggcucgauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggucguacaacgccgagcugcucguggcccuggagaaccagcacaccaucgaccugacggacuccgagaugaacaagcuguucgagaagacccgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucucguucgccaucagcugcuuccugcucugcgucgugcugcugggguucaucaugugggccugccagaagggcaacauccggugcaacaucugcaucuga

SEQ ID NO: 8739 - RNA, 1701 nt, Artificial Sequence; identical to SEQ ID NO: 8732
  derived and/or modified CDS sequence (AUadapt) from InfluenzaA__AFG72272__HA

SEQ ID NO: 8740 - RNA, 1701 nt, Artificial Sequence
  derived and/or modified CDS sequence (AUadapt) from InfluenzaA__AFG72316__HA
augaagaccaucaucgcccugucgcacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcgggagcuacgccugcaagcgcggcuccgugaacucguucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgucgcuguacgugcgcgccuccggccgggucaccgugagcaccaagcgcucgcagcagaccgugacgccgaacaucgggucccggcccuggguccgcggccucagcucccggaucucgaucuacuggaccaucgugaagcccggggacauccugcugaucaacuccaccggcaaccucaucgcgccccgcggcuacuucaagauccggaacgggaaguccuccaucaugcgcagcgacgugccgaucggcaacugcuccucggagugcaucacccccaacggguccauccccaacgacaagcccuuccagaacgucaaccggaucacguacggcgccugcccgcgcuacgugaagcagaacacccugaagcuggccaccgggaugcggaacgugcccgagaagcagacccgcggcaucuucggcgccaucgccggguucaucgagaacggcugggaggggauggucgacggcugguacggguuccggcaccagaacagcgagggcacgggccaggccgccgaccucaaguccacccaggccgcgaucgaccagaucaacgggaagcugaaccgccugaucgagaagaccaacgagaaguuccaccagaucgagaaggaguucucggagguggagggccggauccaggaccucgagaaguacguggaggacaccaagaucgaccugugguccuacaacgccgagcugcucgucgcccuggagaaccagcacacgaucgaccugaccgacagcgagaugaacaagcuguucgagaagacccgcaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaagggcgucgagcucaagucgggguacaaggacuggauccuguggaucuccuucgccaucagcugcuuccugcucugcguggugcugcugggcuucaucaugugggccugccagaaggggaacauccgcugcaacaucugcaucuga

SEQ ID NO: 8741 - RNA, 1701 nt, Artificial Sequence
  derived and/or modified CDS sequence (AUadapt) from InfluenzaA__AFG72339__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgucagccuccggucccugguggcgucguccggcacgcuggaguucaucaacgaggacuucaacuggaccgggguggcccaggacggcgggagcuacacgugcaagcgcggcuccgucaacucguucuucucccggcucaacuggcugcacaagagcgaguacaaguaccccgcccugaacgugaccaugcccaacaacgggaaguucgacaagcucuacaucuggggcgugcaccaccccuccaccgacucggaccagaccucccuguacguccgcgccagcggccgggugaccgugucgaccaagcgcucccagcagacggucaccccgaacaucgggagccggcccugggugcgcggccuguccucgcggaucuccaucuacuggaccaucgugaagcccggggacauccuccugaucaacagcaccggcaaccugaucgcgccccgcggcuacuucaagauccggaacgggaaguccucgaucaugcgcuccgacgccccgaucggcacgugcagcuccgagugcaucacccccaacgggucgauccccaacgacaagcccuuccagaacgucaaccggaucaccuacggcgccugcccgcgcuacgugaagcagaacacccucaagcuggccacggggaugcggaacgugcccgagaagcagacccgcggcaucuucggcgccaucgcgggguucaucgagaacggcugggaggggauggucgacggcugguacggguuccggcaccagaacuccgagggcaccggccaggccgccgaccugaaguccacccaggccgccaucgaccagaucaacgggaagcucaaccgccugaucgagaagacgaacgagaaguuccaccagaucgagaaggaguucuccgagguggagggccggauccaggaccuggagaaguacguggaggacaccaagaucgaccucuggagcuacaacgcggagcugcuggucgcccucgagaaccagcacaccaucgaccugaccgacuccgagaugaacaagcuguucgagaagacgcgcaagcagcuccgcgagaacgccgaggacauggggaacggcugcuucaagaucuaccacaagugcgacaacgccugcaucgggucgauccggaacggcaccuacgaccacgacguguaccgcgacgaggcccugaacaaccgguuccagaucaagggcgucgagcugaaguccggguacaaggacuggauccucuggaucagcuucgcgaucagcugcuuccugcugugcguggugcuccugggcuucaucaugugggccugccagaaggggaacauccgcugcaacaucugcaucuga

SEQ ID NO: 8742 - RNA, 1701 nt, Artificial Sequence
  derived and/or modified CDS sequence (AUadapt) from InfluenzaA__AFG72350__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgucagccuccggucccugguggcgucguccggcacgcuggaguucaucaacgaggacuucaacuggaccgggguggcccaggacggccgcagcuacgccugcaagcggggguccgucaacagcuucuucucccgccucaacuggcugcacaagucggaguacaaguaccccgcccugaacgugaccaugcccaacaacggcaaguucgacaagcucuacaucuggggcgugcaccaccccuccaccgacagcgaccagacgucccuguacguccgggcgucggggcgcgugaccgugagcaccaagcggucccagcagaccgucacgccgaacaucggcucgcgccccugggugcgggggcuguccagccgcaucuccaucuacuggaccaucgugaagcccggcgacauccuccugaucaacagcaccgggaaccugaucgcgccccggggcuacuucaagauccgcaacggcaaguccucgaucaugcgguccgacgccccgaucgggaucugcagcuccgagugcaucacccccaacggcucgauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggcuucaucgagaacgggugggagggcauggucgacgggugguacggcuuccgccaccagaacuccgaggggacgggccaggccgccgaccugaaguccacccaggccgcgaucgaccagaucaacggcaagcucaaccggcugaucgagaagaccaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacacgaucgaccugaccgacuccgagaugaacaagcuguucgagaagacccgcaagcagcuccgggagaacgccgaggacaugggcaacgggugcuucaagaucuaccacaagugcgacaacgccugcaucggcucgauccgcaacgggaccuacgaccacgacguguaccgggacgaggcgcugaacaaccgcuuccagaucaagggcgucgagcugaaguccggcuacaaggacuggauccucuggaucagcuucgccaucagcugcuuccugcugugcguggugcuccugggguucaucaugugggccugccagaagggcaacauccggugcaacaucugcaucuga

SEQ ID NO: 8743 - RNA, 1701 nt, Artificial Sequence
  derived and/or modified CDS sequence (AUadapt) from InfluenzaA__AFG72372__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacacgugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccaccccucgaccgacuccgaccagaccagccuguacgugcgcgcguccgggcgggucaccgugagcaccaagcgcucgcagcagacggugaucccgaacaucggcucccggcccuggguccgcgggcucagcucccggaucucgaucuacuggaccaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucacguacggggccugcccgcgcuacgucaagcagaacacccugaagcuggccaccggcaugcggaacgugcccgagaagcagacccgcgggaucuucggcgccaucgccggcuucaucgagaacgggugggagggcaugguggacgggugguacggcuuccggcaccagaacucggaggggacgggccaggccgccgaccucaaguccacccaggccgcgaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacacgaucgaccugaccgacucggagaugaacaagcuguucgagcgcacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcgcugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 8744 - RNA, 1701 nt, Artificial Sequence; identical to SEQ ID NO: 1269
  derived and/or modified CDS sequence (AUadapt) from InfluenzaA__AFG72383__HA

SEQ ID NO: 8745 - RNA, 1701 nt, Artificial Sequence
  derived and/or modified CDS sequence (AUadapt) from InfluenzaA__AFG72394__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggcgggucaccguggccaccaagcgcagccagcagaccgugaucccgaacaucggcuuccggcccuggguccgcgggcagucguccggcaucagcaucuacuggacgaucgugaagcccggggacauccuccugaucaacuccaccggcaaccugaucgcgccccggggcuacuucaagauccgcaacgggaaguccuccaucaugcggucggacgccccgaucggcaacugcuccagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggcgccaucgccggguucaucgagaacggcugggaggggaugguggacggcugguacggguuccgccaccagaacucggagggcaccggccaggccgcggaccugaaguccacgcaggccgccaucgaccagaucaacgggaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgggcugcugguggcccucgagaaccagcacaccaucgaccugacggacucggagaugaacaagcuguucgagcggacccgcaagcagcuccgcgagaacgcggaggacaugggcaacgggugcuucaagaucuaccacaagugcgacaacgccugcaucggcuccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 8746 - RNA, 1701 nt, Artificial Sequence
  derived and/or modified CDS sequence (AUadapt) from InfluenzaA__AFG72405__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggaccccaacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccaggacggcgggucguacgccugcaagcgcggcuccgugaaguccuucuucucccggcucaacuggcugcacaagcuggaguacaaguaccccgcgcucaacgucaccaugcccaacaacgggaaguucgacaagcuguacaucuggggcgugcaccaccccagcacggacuccgaccagaccucgcuguacgugcgcgccuccggccgggucaccgugagcaccaagcgcucgcagcagacggugaccccgaacaucgggucccggcccuggguccgcggccucucgucccggaucagcaucuacuggaccaucgugaagcccggggacauccugcugaucaacuccaccggcaaccucaucgcgccccgcggcuacuucaagauccggaacggcaagucguccaucaugcgcagcgacgccccgaucgggacgugcuccucggagugcaucacccccaacggguccauccccaacgacaagcccuuccagaacgugaaccggaucaccuacggcgccugcccgcgcuacgucaagcagaacacccugaagcuggccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccucaaguccacccaggcggccaucaaccagaucaacgggaagcugaaccgccugaucgagaagacgaacgagaaguuccaccagaucgagaaggaguucucggaggucgagggccggauccaggaccucgagaaguacguggaggacaccaagaucgaccugugguccuacaacgccgagcugcucguggcccuggagaaccagcacaccaucgaccugaccgacagcgagaugaacaagcuguucgagaagacgcgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 8747 - RNA, 1701 nt, Artificial Sequence
  derived and/or modified CDS sequence (AUadapt) from InfluenzaA__AFG72449__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcuacagcccccaccggauccuggacggcaacaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagagcuacgccugcaagcgcggguccgugaagggcuucuucucgcggcucaacuggcugcacaagcuggaguacaaguaccccgcgcucaacgucaccaugcccaacaacgggaaguucgacaagcuguacaucuggggcgugcaccaccccuccaccgacagcgaccagacgucccuguacgugcgcgccucgggcggggucaccguguccaccaagcggagccagcagaccgugaucccgagcaucggcucccgccccuggguccgggggcucucgucccgcaucagcaucuacuggacgaucgugaagcccggcgacauccugcugaucaacuccaccggcaaccucaucgcgccccggggguacuucaagauccgcaacggcaagucguccaucaugcggagcgacgccccgaucgggaacugcuccagcgagugcaucacccccaacggcuccauccccaacgacaagcccuuccagaacgugaaccgcaucaccuacggggccugcccgcgguacgucaagcagaacacgcugaagcuggccaccggcaugcgcaacgugcccgagaagcagacccggggcaucuucggggccaucgccggcuucaucgagaacgggugggagggcaugguggacgggugguacggcuuccgccaccagaacucggagggcaccgggcaggccgccgaccucaaguccacgcaggcggccaucgaccagaucaacggcaagcugaaccggcugaucgagaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugacggacucggagaugaacaagcuguucgagcggacccgcaagcagcuccgcgagaacgccgaggacaugggcaacgggugcuucaagaucuaccacaagugcgacaacgcgugcaucggcuccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 8748 - RNA, 1701 nt, Artificial Sequence; identical to SEQ ID NO: 1298
  derived and/or modified CDS sequence (AUadapt) from InfluenzaA__AFG72460__HA

SEQ ID NO: 8749 - RNA, 1701 nt, Artificial Sequence
  derived and/or modified CDS sequence (AUadapt) from InfluenzaA__AFG72504__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaaguccuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagauccggaacggcaaguccagcaucauccgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 8750 - RNA, 1701 nt, Artificial Sequence
  derived and/or modified CDS sequence (AUadapt) from InfluenzaA__AFG72515__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggucgcuggucgccuccagcggcacgcuggaguucaucaacgagaacuucaacuggaccgggguggcccaggacggcaaguccuacgccugcaagcgcgggucggugaacuccuucuucagccggcucaacuggcugcacaagcuggaguacaaguaccccgcgcucaacgucaccaugcccaacaacggcaaguucgacaagcuguacaucuggggcgugcaccacccguccaccgacucggaccagacgucccuguacgugcgcgccagcgggcgggucaccguguccaccaagcgcucgcagcagaccgugauccccgacaucggcuaccggcccuggguccgcgggcucagcucccggaucucgaucuacuggacgaucgugaagcccggcgacauccugcugaucaacuccaccgggaaccucaucgccccgcgcggcuacuucaagauccggaacggcaagagcuccaucaugcgcucggacgcccccaucgggaacugcuccagcgagugcaucacccccaacggcuccauccccaacgacaagccguuccagaacgugaaccggaucaccuacggggccugcccccgcuacgucaagcagaacacgcugaagcuggcgaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccuggucgagaagaccaacgagaaguuccaccagaucgagaaggaguucagcgagguggaggggcggauccaggaccucgagaaguacguggaggacaccaagaucgaccugugguccuacaacgccgagcugcucgucgcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggugcugcugggguucaucaugugggccugccagaagggcaacauccggugcaacaucugcaucuga

SEQ ID NO: 8751 - RNA, 1701 nt, Artificial Sequence
  derived and/or modified CDS sequence (AUadapt) from InfluenzaA__AFG72526__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccagcugcuaccccuacgacgugccggacuacgcgucccuccggucgcuggucgccuccagcggcacgcuggaguucaucaacgaggacuucaacuggaccgggguggcccaggacggcaaguccuacgccugcaagcgcgggucggugaacuccuucuucagccggcucaacuggcugcacaagcuggaguacaaguaccccgcgcucaacgucaccaugcccaacaacggcaaguucgacaagcuguacaucuggggcgugcaccaccccuccaccgacagcgaccagacgucccuguacgugcgcgccucggggcgggucaucgugagcaccaagcgcucccagcagaccgugaucccgaacaucggcucgcggcccuggguccgcgggcucuccagccggaucuccaucuacuggaccaucgugaagcccggcgacauccugcugaucaacagcacggggaaccucaucgcgccccgcggcuacuucaagauccggaccggcaaguccucgaucaugcgcuccgacgccccgaucgggaacugcagcuccgagugcaucacccccaacggcucgauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcagaccgcgaucaaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacacgaucgaccugaccgacuccgagaugaacaagcuguucgagcgcacccgcaagcagcuccgggagaacgccgaggacaugggcaacgggugcuucaagaucuaccacaagugcgacaacgccugcaucggcucgauccgcaacgggaccuacgaccacgacgucuaccgggacgaggcgcugaacaaccgcuuccagaucaagggcguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 8752 - RNA, 1701 nt, Artificial Sequence
  derived and/or modified CDS sequence (AUadapt) from InfluenzaA__AFG72581__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggggcgucaccgugagcaccaagcggagccagcagaccgugaucccgaacaucggguaccgccccuggguccggggccucuccucgcgcaucuccaucuacuggacgaucgugaagcccggggacauccugcugaucaacagcaccggcaaccucaucgcgccccggggcuacuucaagauccgcaacgggaaguccucgaucaugcgguccgacgccccgaucggcaacugcagcuccgagugcaucacccccaacgggagcaucuccaacgacaagcccuuccagaacgugaaccgcaucaccuacggcgccugcccccgguacgucaagcagaacacgcugaagcuggccaccgggaugcgcaacgugccggagaagcagacccggggcaucuucggcgccaucgccggguucaucgagaacggcugggaggggaugguggacggcugguacggguuccgccaccagaacucggagggcaccggccaggccgccgaccucaaguccacgcaggcggccaucgaccagaucaacgggaagcugaaccggcugaucgagaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugacggacucggagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 8753 - RNA, 1701 nt, Artificial Sequence
  derived and/or modified CDS sequence (AUadapt) from InfluenzaA__AFG72603__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaaggagggguucaacuggaccggcguggcccaggacgggaaguccuacgccugcaagcgcggcuccgugaacucguucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagauccgcaacggcaagucguccaucaugcggucggacgccccgaucgggaacugcaaguccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaccgaccagaucaacggcaagcugaaccggcugaucgagaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggacguacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 8754 - RNA, 1701 nt, Artificial Sequence
  derived and/or modified CDS sequence (AUadapt) from InfluenzaA__AFG72614__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaccagcuacuccugcaagcgcggcucggugaaguccuucuucagccggcucaacuggcugcacaagcuggaguacaaguaccccgcccucaacgucgcgaugcccaacaacgacaaguucgacaagcuguacaucuggggcgugcaccaccccuccacggacucggaccagaccucccuguacgugcaggccagcgggcgcgucaccgugucgaccaagcggucccagcagacggugaucccgaacaucggcagccgccccuggguccgcgggguguccucgcggaucuccaucuacuggaccaucgugaagcccggcgacauccuccugaucaacagcaccgggaaccugaucgcgccccggggcuacuucaagauccgcuccggcaagucguccaucaugcggagcgacgccccgaucgggaacugcaacuccgagugcaucacccccaacggcucgauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggcuucaucgagaacgggugggagggcauggucgacgggugguacggcuuccgccaccagaacuccgaggggacgggccaggccgccgaccugaaguccacccaggcggccaucaaccagaucaacggcaagcucaaccggcugaucgagaagaccaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacguguaccgcgacgaggcccugaacaaccgguuccagaucaagggcgucgagcugaaguccggcuacaaggacuggauccucuggaucagcuucgccaucagcugcuuccugcugugcguggugcuccugggguucaucaugugggccugccagaagggcaacauccgcugcaacaucugcaucuga

SEQ ID NO: 8755 - RNA, 1701 nt, Artificial Sequence
  derived and/or modified CDS sequence (AUadapt) from InfluenzaA__AFG72625__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugucgacgaagcggagccagcagaccgugaucccgaacaucggcucccgccccuggguccgggggaucucgucccgcaucagcaucuacuggaccaucgugaagcccggcgacauccuccugaucaaguccaccgggaaccugaucgcgccccggggcuacuucaagauccgcucgggcaaguccagcaucaugcgguccgacgccccgaucgggaacugcaacucggagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucucggaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacgucuaccgcgacgaggcccugaacaaccgguuccagaucaagggcguggagcucaagucgggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 8756 - RNA, 1701 nt, Artificial Sequence
  derived and/or modified CDS sequence (AUadapt) from InfluenzaA__AFG72636__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaaguccuacgccugcaagcgcggcuccgucaagagcuucuucucccggcucaacuggcugcacaagcuggaguucaaguaccccgcgcucaacgugaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagauccgcaacggcaagucguccaucaugcggagcgacgccccgaucgacaacugcaacuccgagugcaucacccccaacgggucgauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 8757 - RNA, 1701 nt, Artificial Sequence
  derived and/or modified CDS sequence (AUadapt) from InfluenzaA__AFG72658__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccggauccuggacggcaagaacugcacccugaucgacgcccuccugggggacccccacugcgacggcuuccagaacaaggagugggaccuguucgucgagcgcagcaaggcguacuccaacugcuaccccuacgacgugccggacuacgccucgcuccggucccugguggccagcuccggcacgcuggaguucaccaacgagggguucaacuggaccggcgucgcccaggacgggaaguccuacgcgugcaagcgcggcuccgugaacucguucuucucccggcucaacuggcugcacaagcuggaguacaaguaccccgcccucaacgugaccaugcccaacaacgacaaguucgacaagcuguacaucuggggcguccaccaccccucgacggacuccgaccagaccagccuguacgugcaggccuccgggcgcgugaccgucucgaccaagcggagccagcagacggugaucccgaacaucggcucccgccccugggugcgggggaucucgucccgcaucagcaucuacuggaccaucgucaagcccggcgacauccuccugaucaacuccaccgggaaccugaucgcgccccggggcuacuucaagauccgcaacggcaagucguccaucaugcggucggacgccccgaucgacaacugcaacuccgagugcaucacccccaacgggagcauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacggcugggaggggaugguggacggcugguacggguuccgccaccagaacuccgagggcacggggcaggccgcggaccucaagucgacccaggccgccaucgaccagaucaacggcaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacauggggaacggcugcuucaagaucuaccacaagugcgacaacgccugcaucgggucgauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 8758 - RNA, 1701 nt, Artificial Sequence
  derived and/or modified CDS sequence (AUadapt) from InfluenzaA__AFG72680__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggaucaucugcgacagcccccaccgcauccuggacggcaagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaccaacgagggguucaacuggaccggcguggcccaggacgggaccagcuacgccugcaagcggggcuccgugaaguccuucuucucccgccucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgggucaccgugagcacgcgccggucgcagcagaccgugaucccgaacaucggcucccgccccuggguccgcggggugagcucccggaucucgaucuacuggaccaucgugaagcccggcgacauccuccugaucaacuccaccgggaaccugaucgcgccccggggcuacuucaagauccgcagcggcaaguccucgaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacucggaggggaccggccaggccgccgaccugaaguccacccaggcggccaucaaccagaucaaccggaagcucaaccgccugaucgagaagaccaacgagaaguuccaccagaucgagaaggaguucagcgagguggagggccggauccaggaccuggagaaguacguggaggacacgaagaucgaccucugguccuacaacgccgagcugcuggucgcccucgagaaccagcacaccaucgaccugaccgacucggagaugaacaagcuguucgagcgcacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccagaucaagggggucgagcucaagagcggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 8759 - RNA, 1701 nt, Artificial Sequence
  derived and/or modified CDS sequence (AUadapt) from InfluenzaA__AFG72691__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuucaagaacaaggagugggaccuguucguggagcgcucgacggccuacuccaacugcuaccccuacgacgugccggacuacgcgagccuccggucccuggucgccucguccggcacccuggaguucaccaacgagggguucaacuggaccggcguggcccaggacgggacgagcuacgccugcaagcgcggcuccgugaaguccuucuucucccggcucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgcgucacggugucgaccaagcggagccagcagaccgugaucccgaacaucggcucccgccccuggguccgcggggugucgucccggaucagcaucuacuggaccaucgugaagcccggcgacauccuccugaucaacuccacggggaaccugaucgcgccccggggcuacuucaagauccgcucgggcaaguccagcaucaugcgguccgacgccccgaucgacaacugcaacucggagugcaucacccccaacggguccauccccaacggcaagcccuuccagaacgucaaccgcaucaccuacggggccugcccgcgguacgugaagcagaacacccucaagcuggccacgggcaugcgcaacgugcccgagaagcagacccgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagacgaacgagaaguuccaccagaucgagaaggaguucucggagguggaggggcgcauccaggaccuggagaaguacguggaggacaccaagaucgaccucugguccuacaacgccgagcugcuggucgcccucgagaaccagcacaccaucgaccugaccgacagcgagaugaacaagcuguucgagcggacgcgcaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagucgggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 8760 - RNA, 1701 nt, Artificial Sequence
  derived and/or modified CDS sequence (AUadapt) from InfluenzaA__AFG72713__HA
augaagaucaucaucgcccugucguacauccucugccugguguucgcccagaagcugcccggcaacgacaacuccaccgcgacccucugccuggggcaccacgccgucccgaacggcacgcuggugaagaccaucaccaacgaccagaucgaggugaccaacgccacggagcucguccagagcuccucgaccgggcgcaucugcgacagcccccaccagauccuggacggcaagaacugcacccugaucgacgcccuccugggggacccccacugcgacggcuucaagaacaaggagugggaccuguucguggagcggucgaccgccuacuccaacugcuaccccuacgacgugccggacuacgcgagccuccgcucccuggucgccucguccggcacgcuggaguucaccaacgagggguucaacuggaccggcguggcccaggacgggaccagcuacgccugcaagcggggcuccgugaaguccuucuucucccgccucaacuggcugcacaagcuggaguacaaguaccccgcgcucaacgucacgaugcccaacaacgacaaguucgacaagcuguacaucuggggcgugcaccaccccagcaccgacuccgaccagaccucgcuguacgugcaggccuccgggcgggucaccgugagcacgaagcgcucgcagcagaccgugaucccgaacaucggcucccggcccuggguccgcgggaucagcucccggaucucgaucuacuggaccaucgugaagcccggcgacauccuccugaucuccagcaccgggaaccugaucgcgccccgcggcuacuucaagauccgguccggcaagagcuccaucauccgcucggacgccccgaucgacaacugcaacuccgagugcaucacgcccaacgggagcauccccaacgacaagcccuuccagaacgugaaccggaucaccuacggcgccugcccgcgcuacgucaagcagaacacccucaagcuggccaccgggaugcggaacgugcccgagaagcagacgcgcggcaucuucggggccaucgccggcuucaucgagaacggcugggaggggaugguggacggcugguacggguuccggcaccagaacuccgagggcaccgggcaggccgccgaccucaagucgacccaggcggccaucaaccagaucaacggcaagcugaaccgccugaucgagaagaccaacgagaaguuccaccagaucgagaaggaguucuccgaggucgagggccggauccaggaccuggagaaguacguggaggacacgaagaucgaccucuggagcuacaacgccgagcugcugguggcccucgagaaccagcacaccaucgaccugaccgacuccgagaugaacaagcuguucgagcgcacccggaagcagcuccgcgagaacgccgaggacauggggaacggcugcuucaagaucuaccacaagugcgacaacgcgugcaucgggucgauccgcaacggcacguacgaccacgacgucuaccgggacgaggcccugaacaaccgcuuccagaucaaggggguggagcugaaguccggcuacaaggacuggauccucuggaucagcuucgccaucagcugcuuccugcugugcgucgugcuccugggcuucaucaugugggccugccagaaggggaacauccggugcaacaucugcaucuga

SEQ ID NO: 8761 - RNA, 1701 nt, Artificial Sequence
  derived and/or modified CDS sequence (AUadapt) from InfluenzaA__AFG72724__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugagcacgaagcggucgcagcagaccgugaucccgaacaucggcucccgccccuggguccgcggggugagcucccggaucucgaucuacuggaccaucgugaagcccggcgacauccuccugaucaacuccaccgggaaccugaucgcgccccggggcuacuucaagauccgcagcggcaaguccucgaucaugcgguccgacgccccgaucgacaacugcaacagcgagugcaucacgcccaacggguccauccccaacgacaagcccuuccagaacgucaaccgcaucaccuacggcgccugcccgcgguacgugaagcagaacacccucaagcuggccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcucaaccggcugaucgagaagaccaacgagaaguuccaccagaucgagaaggaguucagcgagguggagggccgcauccaggaccuggagaaguacguggaggacacgaagaucgaccucugguccuacaacgccgagcugcuggucgcccucgagaaccagcacaccaucgaccugaccgacucggagaugaacaagcuguucgagcggacccgcaagcagcuccgcgagaacgccgaggacauggggaacggcugcuucaagaucuaccacaagugcgacaacgugugcaucggguccauccggaacggcacguacgaccacgacgucuaccgcgacgaggcgcugaacaaccgguuccagaucaaggggguggagcucaagagcggcuacaaggacuggauccuguggaucuccuucgccaucagcugcuuccugcugugcgugguccuccugggcuucaucaugugggccugccagaaggggaacauccgcugcaacaucugcaucuga

SEQ ID NO: 8762 - RNA, 1701 nt, Artificial Sequence
  derived and/or modified CDS sequence (AUadapt) from InfluenzaA__AFG72735__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuucaagaacaaggagugggaccuguucguggagcgcucgacggccuacuccaacugcuaccccuacgacgugccggacuacgcgagccuccggucccuggucgccucguccggcacccuggaguucaccaacgagggguucaacuggaccggcguggcccaggacgggacgagcuacgccugcaagcgcggcuccgugaaguccuucuucucccggcucaacuggcugcacaagcuggaguacaaguaccccgcgcucaccgucaccaugcccaacaacgacaaguucgacaagcuguacaucuggggcgugcaccaccccucgaccgacuccgaccagacgagcaucuacgugcaggccuccgggcgcgucaccgugucgaccaagcggagccagcagaccgugaucccgaacaucggcucccgccccuggguccgcggggugucgucccggaucagcaucuacuggacgaucgugaagcccggcgacauccugcucaucaacuccaccgggaaccugaucgcgccccggggcuacuucaagauccgcucgggcaaguccagcaucaugcgguccgacgccccgaucgacaacugcaacucggagugcaucacccccaacggguccauccccaacgacaagcccuuccagaacgucaaccgcaucaccuacggcgccugcccgcgguacgugaagcagaacacgcugaagcucgccaccgggaugcgcaacgugcccgagaagcagacccggggcaucuucggggccaucgccggcuucaucgagaacggcugggaggggauggucgacggcugguacggguuccgccaccagaacagcgagggcaccgggcaggccgccgaccugaaguccacgcaggcggccaucaaccagaucaacggcaagcugaaccggcucaucgagaagaccaacgagaaguuccaccagaucgagaaggaguucucggagguggagggccgcauccaggaccuggagaaguacguggaggacaccaagaucgacaucugguccuacaacgccgagcugcucgucgcccuggagaaccagcacaccaucgaccugacggacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagucgggcuacaaggacuggauccuguggaucuccuucgccaucagcugcuuccugcucugcguggugcugcugggcuucaucaugugggccugccagaaggggaacauccgcugcaacaucugcaucuga

SEQ ID NO: 8763 - RNA, 1701 nt, Artificial Sequence
  derived and/or modified CDS sequence (AUadapt) from InfluenzaA__AFG72757__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcgagaacugcacccugaucgacgcccugcucggggacccccacugcgacggcuuccagaacaaggagugggaccuguucguggagcgcuccaaggccuacuccaacugcuaccccuacgacgugccggacuacgcgagccugcggucccucgucgccucguccggcacgcuggaguucaacaacgagagcuucaacuggaccgggguggcccagaacggcaccuccuacgccugcaagcgcucguccaucaagagcuucuucucccggcugaacuggcuccaccagcugaaguacaaguaccccgcgcugaacgugaccaugcccaacaacgacaaguucgacaagcucuacaucuggggcguccaccaccccucgacggacuccgaccagaccagcaucuacgcccaggccucggggcgcgugaccguguccaccaagcggagccagcagacggucaucccgaacaucgggucccgccccugggugcggggcaucucgucccgcaucagcauccacuggaccaucgugaagcccggcgacauccugcugaucaacuccaccgggaaccucaucgcgccccggggcuacuucaagauccgcucggggaaguccagcaucaugcgguccgacgccccgaucggcaagugcaacucggagugcaucacccccaacggcuccauccccaacgacaagcccuuccagaacgucaaccgcaucacguacggggccugcccgcgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacagcgaggggacgggccaggccgcggaccucaaguccacccaggccgccaucaaccagaucaacgggaagcugaaccggcugaucgagaagaccaacgagaaguuccaccagaucgagaaggaguucucggagguggagggccgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcguggagcucaagucgggguacaaggacuggauccuguggaucagcuucgccaucuccugcuuccugcucugcgucgugcugcugggcuucaucaugugggccugccagaagggcaacauccgcugcaacaucugcaucuga

SEQ ID NO: 8764 - RNA, 1701 nt, Artificial Sequence
  derived and/or modified CDS sequence (AUadapt) from InfluenzaA__AFG72779__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccgggguggcccagaacggcaccuccagcgccugcaagcgccgguccaucaagucguucuucucccgccucaacuggcugcaccagcugaaguacaaguaccccgcgcucaacgugaccaugcccaacaacgacaaguucgacaagcuguacaucuggggcguccaccaccccagcacggacuccgaccagaccucgcuguacgcccaggccagcgggcgggugaccguguccacccgccggucgcagcagacggucaucccgaacaucgggucccgccccugggugcggggcgugagcuccggcaucucgaucuacuggaccaucgucaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucacguacggcgccugcccgcgcuacgugaagcagaacacccucaagcuggccaccgggaugcggaacguccccgagaagcagacccgcggcaucuucggggccaucgccggcuucaucgagaacggcugggaggggaugguggacggcugguacggguuccggcaccagaacucggagggcacggggcaggccgcggaccugaaguccacccaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacucggagaugaacaagcuguucgagcgcacccgcaagcagcuccgggagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 8765 - RNA, 1701 nt, Artificial Sequence
  derived and/or modified CDS sequence (AUadapt) from InfluenzaA__AFG72801__HA
augaagaccaucaucgcccugucguacauccucugccugguguucgcccagaagcugcccggcaacgacaacuccaccgcgacgcucugccuggggcaccacgccgucagcaacggcacccuggugaagaccaucaccaacgaccagaucgaggugacgaacgccaccgagcucguccaguccucguccaccgggcgcaucugcgacagcccgcaccagauccuggacggcgagaacugcacccugaucgacgcccuccugggggacccccacugcgacggcuuccagaacaaggagugggaccuguucguggagcgguccaaggccuacucgaacugcuaccccuacgacgugcccgacuacgcgucccuccgcagccuggucgccuccucgggcacgcuggaguucaacaacgaguccuucaacuggaccgggguggcccagaacggcaccagcuccgccugcaagcggcgcagcaacaaguccuucuucucgcggcucaacuggcugcaccagcugaaguacaaguacccggcgcucaacgugaccaugcccaacaacgagaaguucgacaagcuguacaucuggggcguccaccaccccuccacggacagcgaccagaucucgaucuacgcccaguccagcgggcgcgugaccguguccaccaagcggucgcagcagaccgucauccccaacaucggguccagcccgugggugcgcggcguguccucgcggaucuccaucuacuggacgaucgucaagcccggcgacauccugcucaucaacagcaccgggaaccugaucgcgccccgcggcuacuucaagauccgguccggcaagagcuccaucaugcgcucggacgcccccaucgggaagugcaacuccgagugcaucaccccgaacggcagcauccccaacgacaagcccuuccagaacgugaaccggaucaccuacggggccugcccccgcuacgugaagcagaacacgcugaagcucgccaccggcaugcggaacgucccggagaagcagacccgcgggaucuucggcgccaucgccggguucaucgagaacggcugggagggcaugguggacgggugguacggcuuccggcaccagaacuccgaggggaccggccaggccgccgaccucaagucgacgcaggcggccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacucggagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcucaagagcggguacaaggacuggauccuguggaucuccuucgccaucagcugcuuccugcugugcgugguccugcucggcuucaucaugugggccugccagaagggcaacauccgcugcaacaucugcaucuga

SEQ ID NO: 8766 - RNA, 1701 nt, Artificial Sequence
  derived and/or modified CDS sequence (AUadapt) from InfluenzaA__AFG72812__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccugaacuccgagggcaccgggcaggccgccgaccucaagucgacgcaggcggccaucaaccagaucaacggcaagcugaaccggcugaucgagaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggucgauccgcaacggcaccuacgaccacgacguguaccgggacgaggcccugaacaaccgcuuccagaucaagggggucgagcucaaguccggcuacaaggacuggauccuguggaucagcuucgccaucagcugcuuccugcucugcaucgugcugcugggcuucaucaugugggccugccagaaggggaacauccggugcaacaucugcaucuga

SEQ ID NO: 8767 - RNA, 1701 nt, Artificial Sequence
  derived and/or modified CDS sequence (AUadapt) from InfluenzaA__AFG72823__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcguccugcaccccgggaccgacagcgaccagaucucccuguacgcgcaggccucgggccggaucaccgugagcacgaagcgcucccagcagaccgugaucccgaacaucggcucgcggccccgcguccgcgggguguccucgcggaucuccaucuacuggaccaucgugaagcccggcgacauccuccugaucaacagcaccgggaaccugaucgcgccccggggcuacuucaagauccgcuccggcaagucguccaucaugcggagcgacgccccgaucgggaagugcaacuccgagugcaucacgcccaacggcucgauccccaacgacaagcccuuccagaacgucaaccgcaucaccuacggggccugcccgcgguacaucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacuccgaggggaccggccaggccgccgaccugaaguccacccaggcggccaucaaccagaucaacggcaagcucaaccggcugaucgggaagaccaacgagaaguuccaccagaucgagaaggaguucuccgaggucgagggccgcauccaggaccuggagaaguacguggaggacacgaagaucgaccucuggucguacaacgccgagcugcugguggcccucgagaaccagcacaccaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcacguacgaccacgacgucuaccgggacgaggcccugaacaaccgcuuccagaucaagggcguggagcugaaguccggguacaaggacuggauccucuggaucucguucgccaucagcugcuuccugcugugcguggcccuccugggcuucaucaugugggccugccagaaggggaacauccggugcaacaucugcaucuga

SEQ ID NO: 8768 - RNA, 1701 nt, Artificial Sequence
  derived and/or modified CDS sequence (AUadapt) from InfluenzaA__AFG72834__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccaguccggcaagagcuccaucaugcgcucggacgccccgaucggcaagugcaacuccgagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcaucgugcuccugggcuucaucaugugggccugccagaaggggaacauccgcugcaacaucugcaucuga

SEQ ID NO: 8769 - RNA, 1701 nt, Artificial Sequence
  derived and/or modified CDS sequence (AUadapt) from InfluenzaA__AFG72845__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccucccgcaucugcgacucgccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcucgcugguggcguccagcggcacgcuggaguucaacaacgaguccuucaacuggaccggcguggcccagaacgggaccucguccgccugcaagcggcgcagcgacaaguccuucuucucgcggcucaacuggcugcaccagcugcgcuacaaguaccccgcccucaacgucaccaugcccaacaacgagaaguucgacaagcuguacaucuggggcgugcaccaccccgggacggacuccgaccagaucagccuguacgcgcaggccucgggccgggugaccaucuccaccaagcgcagccagcagaccgucaucccgaacaucgggucccggcccugggugcgcggcgugucgucccggaucagcauccacuggacgaucgucaagcccggcgacauccuccugaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucaccuacggggccugcccgcgcuacgugaagcagaagacgcucaagcuggccaccggcaugcggaacguccccgagaagcagacccgcgggaucuucggcgccaucgccggguucaucgagaacggcugggagggcaugauggacgggugguacggcuuccggcaccagaacagcgaggggaccggccaggccgccgaccugaaguccacgcaggcggccaucaaccagaucaacgggaagcucaaccgccugaucgagaagaccaacgagaaguuccaccagaucgagaaggaguucucggagguggagggccggauccaggaccuggagaaguacguggaggacaccaagaucgaccucugguccuacaacgccgagcugcuggucgcccucgagaaccagcacaccaucgaccugacggacagcgagaugaacaagcuguucgagcgcaccaagaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcguggagcucaagucgggguacaaggacuggauccuguggaucagcuucgccaucuccugcuuccugcugugcaucguccuccugggcuucaucaugugggccugccagaagggcaacauccgcugcaacaucugcaucuga

SEQ ID NO: 8770 - RNA, 1701 nt, Artificial Sequence
  derived and/or modified CDS sequence (AUadapt) from InfluenzaA__AFG72856__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaccaacgagagcuucaacuggaccggcgucacccagaacgggacguccucggccugcaagcgccgguccaacaagucguucuucucccgccugaacuggcucacccaccugaaguacaaguaccccgcccugaacgugaccaugcccaacaacgagaaguucgacaagcucuacaucuggggcgugcaccaccccgggaccgacagcgaccagaucucccuguacgcgcaggccucgggccggaucacggucagcaccaagcgcucccagcagaccgugaucccgaacaucggcucgcggccccgcgugcgggacaucuccucgcgcaucuccaucuacuggaccaucgucaagcccggggacauccugcucaucaacagcacgggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcgccugcccgcgguacgugaagcagaacacccugaagcucgccacggggaugcgcaacguccccgagaagcagacccggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaacaagcucaucggcaagacgaacgagaaguuccaccagaucgagaaggaguucuccgagguggaggggcggauccaggaccuggagaaguacgucgaggacaccaagaucgaccuguggucguacaacgccgagcuccugguggcccuggagaaccagcacaccaucgaccucaccgacuccgagaugaacaagcuguucgagcgcacgaagaagcagcugcgggagaacgccgaggacaugggcaacgggugcuucaagaucuaccacaagugcgacaacgcgugcaucggcagcauccgcaacgggaccuacgaccacgacguguaccgcgacgaggcccucaacaaccgguuccagaucaagggcgucgagcugaaguccggcuacaaggacuggauccuguggaucucguucgccaucagcugcuuccuccugugcguggugcugcucggguucaucaugugggccugccagaagggcaacauccgcugcaacaucugcaucuga

SEQ ID NO: 8771 - RNA, 1701 nt, Artificial Sequence
  derived and/or modified CDS sequence (AUadapt) from InfluenzaA__AFG72867__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccaacaagucguucuucucccggcucaacuggcugcaccagcugaagaacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgcccccgggugcgcgacaucuccucgcggaucuccaucuacuggacgaucgucaagcccggcgacauccuccugaucaacagcaccgggaaccugaucgcgccccgcggcuacuucaagauccgguccgggaaguccuccaucaugcgcucggacgccccgaucggcaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugauggacgggugguacggcuuccggcaccagaacuccgaggggaccggccaggccgccgaccucaagucgacgcaggcggccaucaaccagaucaacgggaagcugaaccgccugaucgagaagaccaacgagaaguuccaccagaucgagaaggaguucuccgagguggagggccggauccaggaccuggagaaguacguggaggacaccaagaucgaccucuggucguacaacgccgagcugcuggucgcccucgagaaccagcacaccaucgaccugacggacuccgagaugaacaagcuguucgagcgcaccaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcguggagcugaaguccggguacaaggacuggauccucuggaucucguucgccaucagcugcuuccugcugugcaucguccuccugggcuucaucaugugggccugccagaagggcaacauccgcugcaacaucugcaucuga

SEQ ID NO: 8772 - RNA, 1701 nt, Artificial Sequence
  derived and/or modified CDS sequence (AUadapt) from InfluenzaA__AFG72922__HA
augaagaccaucaucgcccugucguacauccucugccugguguucgcccagaagcugcccggcgacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcuccugcauccgcaagucgaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcccaggcguccgggcgcaucaccgugucgacgaagcggagccagcagaccgugaucccgaacaucggcucccgcccccggguccgcaacauccccucgcggaucuccaucuacuggaccaucgugaagcccggcgacauccugcucaucaacagcaccgggaaccugaucgccccgcgcggcuacuucaagauccgguccgggaaguccuccaucaugcgcucggacgcccccaucggcaagugcaacuccgagugcaucacgcccaacggcagcauccccaacgacaagccguuccagaacgugaaccggaucaccuacggggccugcccccgcuacgucaagcagaacacccugaagcucgccaccggcaugcggaacgugcccgagaagcagacgcgcgggaucuucggcgcgaucgccggguucaucgagaacggcugggagggcaugguggacgggugguacggcuuccggcaccagaacuccgaggggcgcggccaggccgccgaccucaagucgacccaggccgcgaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgccugcaucgggucgauccgcaacggcaccuacgaccacgacgucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 8773 - RNA, 1701 nt, Artificial Sequence
  derived and/or modified CDS sequence (AUadapt) from InfluenzaA__AFG72933__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcgugcgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucuuccuguacgcgcaggccucggggcggaucaccguguccacgaagcgcagccagcagaccgucaucccgaacaucggcucgcggccccgcgugcggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 8774 - RNA, 1701 nt, Artificial Sequence
  derived and/or modified CDS sequence (AUadapt) from InfluenzaA__AFG72955__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccucggccugcauccgccgguccaacaacagcuucuucucccgccugaacuggcucacgcaccuccgguucaaguaccccgcccugaacgugaccaugcccaacaacgagcaguucgacaagcuguacaucuggggcgugcaccaccccgggaccgacaacgaccagaucuuccuguacgcgcaggccucggggcgcaucaccgucuccacgaagcggagccagcagaccgugaucccgaacaucggcucgcgcccccgggugcgcaacauccccucccggaucagcaucuacuggaccaucgucaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8775 - RNA, 1701 nt, Artificial Sequence; identical to SEQ ID NO: 1885
  derived and/or modified CDS sequence (AUadapt) from InfluenzaA__AFG98808__HA

SEQ ID NO: 8776 - RNA, 1701 nt, Artificial Sequence; identical to SEQ ID NO: 1885
  derived and/or modified CDS sequence (AUadapt) from InfluenzaA__AFG98819__HA

SEQ ID NO: 8777 - RNA, 1701 nt, Artificial Sequence
  derived and/or modified CDS sequence (AUadapt) from InfluenzaA__AFG98830__HA
augaagaccaucaucgcccugucguacaucuucugccucgugcugggccaggaccugcccgggaacgacaaguccaccgccacgcucugccugggccaccacgcggucccgaacgggacccuggugaagaccaucaccaacgaccagaucgaggugacgaacgccaccgagcucguccagagcuccucgaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcucgcuggucgcguccagcgggacccuggaguucaucaccgagggcuucaccuggacgggggugacccagaacggcggguccucggccugcaagcggggccccggcuccggguucuucagccgccucaacuggcugaccaaguccggcucgaccuaccccgugcugaacgucacgaugcccaacaacgacaacuucgacaagcucuacaucuggggcgugcaccacccguccaccaaccaggagcagaccagccuguacgugcaggccuccgggcgggucaccgugucgacgcgccggagccagcagaccaucauccccaacaucggcucccgccccugggugcgggggcugucgucccgcaucagcaucuacuggaccaucgucaagcccggcgacauccucaucaucaacuccaacgggaaccugaucgccccgcggggcuacuucaagaugcgcaccggcaagucguccaucaugcggagcgacgcgcccaucgacacgugcaucuccgagugcaucacccccaacgggucgauccccaacgacaagccguuccagaacgugaacaagaucaccuacggcgccugccccaaguacgugaagcagaacacccugaagcucgccacggggaugcgcaacguccccgagaagcagacccggggccuguucggggccaucgccggcuucaucgagaacgggugggagggcaugaucgacggcugguacggguuccgccaccagaacuccgagggcaccgggcaggcggccgaccucaagagcacccaggccgccaucgaccagaucaacggcaagcugaaccgggugaucgagaagacgaacgagaaguuccaccagaucgagaaggaguucuccgagguggaggggcgcauccaggaccuggagaaguacgucgaggacaccaagaucgaccuguggucguacaacgccgagcuccugguggcgcuggagaaccagcacaccaucgaccucaccgacuccgagaugaacaagcuguucgagaagacgcggcgccagcugcgggagaacgccgaggacaugggcaacggcugcuucaagaucuaccacaagugcgacaacgccugcaucgggagcauccgcaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcgugguccugcucggcuucaucaugugggcgugccagaaggggaacauccgcugcaacaucugcaucuga

SEQ ID NO: 8778 - RNA, 1701 nt, Artificial Sequence
  derived and/or modified CDS sequence (AUadapt) from InfluenzaA__AFG98841__HA
augaagaccaucaucgcccugucguacaucuucugccucgugcugggccaggaccugcccgggaacgacaaguccaccgccacgcucugccugggccaccacgcggucccgaacgggacccuggugaagaccaucaccaacgaccagaucgaggugacgaacgccaccgagcucguccagucguccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucucgaacugcuaccccuacgacgugccggacuacgccucccuccgcagccuggucgcguccucggggacccuggaguucaucaccgagggcuucaccuggacgggggugacccagaacggcggguccaacgccugcaagcggggccccggcagcggguucuucucccgccucaacuggcugaccaagucgggcuccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcgggggcuguccagccgcaucuccaucuacuggaccaucgucaagcccggcgacauccucaucaucaacucgaacgggaaccugaucgccccgcggggcuacuucaagaugcgcaccgggaaguccagcaucaugcgguccgacgcgcccaucggcacgugcaucucggagugcaucacccccaacggcuccauccccaacgacaagccguuccagaacgugaacaagaucaccuacggggccugccccaaguacgugaagcagaacacccugaagcucgccacgggcaugcgcaacguccccgagaagcagacccgggggcuguucggcgccaucgccggguucaucgagaacggcugggagggcaugaucgacgggugguacggcuuccgccaccagaacagcgaggggaccggccaggcggccgaccugaaguccacccaggccgccaucgaccagaucaacgggaagcucaaccgggugaucgagaagacgaacgagaaguuccaccagaucgagaaggaguucucggagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcgucgagcucaagucgggcuacaaggacuggauccuguggaucuccuucgccaucagcugcuuccugcugugcgugguccugcucggguucaucaugugggcgugccagaagggcaacauccgcugcaacaucugcaucuga

SEQ ID NO: 8779 - RNA, 1701 nt, Artificial Sequence; identical to SEQ ID NO: 550
  derived and/or modified CDS sequence (AUadapt) from InfluenzaA__AFG98852__HA

SEQ ID NO: 8780 - RNA, 1701 nt, Artificial Sequence
  derived and/or modified CDS sequence (AUadapt) from InfluenzaA__AFG98863__HA
augaagaccaucaucgcccugucguacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccucgaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcucgcuggucgcguccagcgggacccuggaguucaucaacgagggcuucaccuggaccggggugacgcagaacggcggguccagcgccugcaagcggggccccgacuccggcuucuucucgcgccucaacuggcuguacaaguccgggagcaccuaccccgugcugaacgucaccaugcccaacaacgacaacuucgacaagcucuacaucuggggcgugcaccacccguccaccaaccaggagcagacgucgcuguacgugcaggccuccgggcgggucaccgugagcaccaagcgcucgcagcagaccaucauccccaacaucggcucccggcccugggugcgcggccugagcucccggaucagcaucuacuggacgaucgucaagcccggggacauccucgugaucaacuccaacggcaaccugaucgccccgcgcggguacuucaagaugcggaccggcaagucguccaucaugcgcagcgacgcgcccaucgggaccugcaucuccgagugcaucacccccaacggcucgauccccaacgacaagccguuccagaacgugaacaagaucacguacggcgccugccccaaguacgucaagcagaacacccugaagcucgccaccgggaugcggaacgugcccgagaagcagacccgcggccuguucggggccaucgccggcuucaucgagaacgggugggagggcaugaucgacggcugguacggguuccggcaccagaacuccgagggcacggggcaggcggccgaccucaagagcacccaggccgccaucgaccagaucaacggcaagcugaaccgcgugaucgagaagaccaacgagaaguuccaccagaucgagaaggaguucuccgaggucgaggggcggauccaggaccuggagaaguacguggaggacaccaagaucgaccuguggucguacaacgccgagcuccugguggcgcuggagaaccagcacacgaucgaccucaccgacuccgagaugaacaagcuguucgagaagacccgccggcagcugcgcgagaacgccgaggacaugggcaacggcugcuuccggaucuaccacaagugcgacaacgccugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggcuucaucaugugggcgugccagaaggggaacauccgcugcaacaucugcaucuga

SEQ ID NO: 8781 - RNA, 1701 nt, Artificial Sequence
  derived and/or modified CDS sequence (AUadapt) from InfluenzaA__AFG98874__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaacgagggcuucaccuggaccggggugacgcagaacggcggguccaacgccugcaagcggggccccgacaacggcuucuucucgcgccugaacuggcucuacaaguccgggagcaccuaccccgugcugaacgucaccaugcccaacaacgacaacuucgacaagcuguacaucuggggcgugcaccacccguccaccgaccaggagcagacgucgcucuacgugcaggccuccgggcgggucaccgugagcaccaagcgcucccagcagaccaucauccccaacaucggcagccggcccugggugcgcggccugucgucccggaucagcaucuacuggacgaucgucaagcccggggacauccuggugaucaacuccaacggcaaccucaucgccccgcgcggguacuucaagaugcggaccggcaagucguccaucaugcgcagcgacgcgcccaucgggaccugcaucuccgagugcaucacccccaacggcucgauccccaacgacaagccguuccagaacgugaacaagaucacguacggcgccugccccaaguacgucaagcagaacacccugaagcuggccaccgggaugcggaacgugcccgagaagcagacccgcggccucuucggggccaucgccggcuucaucgagaacgggugggagggcaugaucgacggcugguacggguuccggcaccagaacuccgagggcacggggcaggcggccgaccucaagagcacccaggccgccaucgaccagaucaacggcaagcugaaccgcgugaucgagaagaccaacgagaaguuccaccagaucgagaaggaguucuccgaggucgaggggcggauccaggaccucgagaaguacguggaggacaccaagaucgaccuguggucguacaacgccgagcugcucguggcgcuggagaaccagcacacgaucgaccugaccgacuccgagaugaacaagcuguucgagaagacccgccggcagcugcgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcucaaguccggcuacaaggacuggauccuguggaucagcuucgccaucuccugcuuccugcucugcgucgugcugcugggcuucaucaugugggcgugccagaaggggaacauccggugcaacaucugcaucuga

SEQ ID NO: 8782 - RNA, 1701 nt, Artificial Sequence
  derived and/or modified CDS sequence (AUadapt) from InfluenzaA__AFG98885__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaacgagggcuucaccuggaccggggugacgcagaacggcggguccaacgccugcaagcggggcaccgacagcggcuucuucucccgccugaacuggcucuacaagucgggguccaccuaccccgugcugaacgucaccaugcccaacaacgacaacuucgacaagcuguacaucuggggcgugcaccaccccagcacggaccaggagcagaccucccucuacgugcaggccucggggcgggucaccguguccaccaagcgcagccagcagacgaucaucccgaacaucggcucgcggcccugggugcgcggccuguccagccggaucuccaucuacuggaccaucgucaagcccggggacauccuggugaucaacagcaacggcaaccucaucgcgccccgcggguacuucaagaugcggaccggcaaguccucgaucaugcgcuccgacgccccgaucgggaccugcaucagcgagugcaucacgcccaacggcuccauccccaacgacaagcccuuccagaacgugaacaagaucaccuacggcgccugcccgaaguacgucaagcagaacacccugaagcuggccaccgggaugcggaacgugcccgagaagcagacgcgcggccucuucggggccaucgccggcuucaucgagaacgggugggagggcaugaucgacggcugguacggguuccggcaccagaacucggagggcaccgggcaggcggccgaccugaaguccacccaggccgccaucgaccagaucaacggcaagcugaaccgcgugaucgagaagaccaacgagaaguuccaccagaucgagaaggaguucagcgaggucgaggggcggauccaggaccucgagaaguacguggaggacacgaagaucgaccugugguccuacaacgccgagcugcucguggcgcuggagaaccagcacaccaucgaccugaccgacucggagaugaacaagcuguucgagaagacccgccggcagcuccgcgagaacgccgaggacaugggcaacggcugcuucaagaucuaccacaagugcgacaacgccugcaucggguccauccggaacggcacguacgaccacgacgucuaccgcgacgaggcccugaacaaccgcuuccagaucaaggggguggagcucaagagcggcuacaaggacuggauccuguggaucuccuucgccaucagcugcuuccugcucugcgucgugcugcugggcuucaucaugugggcgugccagaaggggaacauccggugcaacaucugcaucuga

SEQ ID NO: 8783 - RNA, 1701 nt, Artificial Sequence
  derived and/or modified CDS sequence (AUadapt) from InfluenzaA__AFG98896__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucaacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaacgagggcuucaccuggaccggggugacgcagaacggcggguccaacgccugcaagcggggccccgacucgggcuucuucucccgccugaacuggcucuacaagagcggguccgccuaccccgugcugaacgucaccaugcccaacaacgacaacuucgacaagcuguacaucuggggcgugcaccacccgucgaccgaccaggagcagaccaaccucuacgugcagacguccgggcgggucaccgugagcaccaagcgcucccagcagaccaucauccccaacaucggcagccggcccugggugcgcggccugucgucccggaucagcaucuacuggacgaucgucaagcccggggacauccuggugaucaacuccaacggcaaccucaucgccccgcgcggguacuucaagaugcggaccggcaagucguccaucaugcgcagcgacgcgcccaucgggaccugcaucuccgagugcaucacccccaacggcucgauccccaacgacaagccguuccagaacgugaacaagaucacguacggcgccugccccaaguacgucaagcagaacacccugaagcuggccaccgggaugcggaacgugcccgagaagcagacccgcggcaucuucggggccaucgccggcuucaucgagaacgggugggagggcaugaucgacggcugguacggguuccggcaccagaacuccgagggcacggggcaggcggccgaccucaagagcacccaggccgccaucgaccagaucaacggcaagcugaaccgcgugaucgagaagaccaacgagaaguuccaccagaucgagaaggaguucuccgaggucgaggggcggauccaggaccuggagaaguacguggaggacaccaagaucgaccucuggucguacaacgccgagcugcugguggcgcucgagaaccagcacacgaucgaccugaccgacuccgagaugaacaagcuguucgagaagacccgccggcagcuccgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcugaaguccggcuacaaggacuggauccucuggaucagcuucgccaucuccugcuuccugcugugcgucgugcuccugggcuucaucaugugggcgugccagaaggggaacauccggugcaacaucugcaucuga

SEQ ID NO: 8784 - RNA, 1701 nt, Artificial Sequence
  derived and/or modified CDS sequence (AUadapt) from InfluenzaA__AFG98907__HA
augaagaccaucaucgcccugucguacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccucgaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgugccggacuacgccucccuccgcucgcuggucgcguccagcgggacgcuggaguucaucaacgagggcuucaacuggaccggggugacccagaacggcggguccaacgccugcaagcggggccccgacugcggcuucuucucgcgccucaacuggcuguacaaguccgggagcaccuaccccgugcugaacgucacgaugcccaacaacgacaacuucgacaagcucuacaucuggggcgugcaccacccguccaccgaccaggagcagaccaaccuguacgugcaggccucggggcgggucaccguguccacgaagcgcagccagcagaccaucauccccaacaucggcucccggcccugggugcgcggccugucgagccggaucuccaucuacuggaccaucgucaagcccggggacauccucgugaucaacucgaacggcaaccugaucgccccgcgcggguacuucaagaugcggaccggcaaguccagcaucaugcgcuccgacgcgcccaucgggacgugcaucucggagugcaucacccccaacggcuccauccccaacgacaagccguuccagaacgugaacaagaucaccuacggcgccugccccaaguacgucaagcagaacacccugaagcucgccacggggaugcggaacgugcccgagaagcagacccgcggcaucuucggggccaucgccggcuucaucgagaacgggugggagggcaugaucgacggcugguacggguuccggcaccagaacagcgagggcaccgggcaggcggccgaccugaaguccacccaggccgccaucgaccagaucaacggcaagcugaaccgcgugaucgagaagacgaacgagaaguuccaccagaucgagaaggaguucucggaggucgaggggcggauccaggaccucgagaaguacguggaggacaccaagaucgaccugugguccuacaacgccgagcugcucguggcgcuggagaaccagcacaccaucgaccugaccgacagcgagaugaacaagcuguucgagaagacgcgccggcagcuccgcgagaacgccgaggacaugggcaacggcugcuucaagaucuaccacaagugcgacaacgccugcaucggguccauccggaacggcaccuacaaccacgacgucuaccgcgacgaggcccugaacaaccgcuuccagaucaaggggguggagcucaagucgggcuacaaggacuggauccuguggaucuccuucgccaucagcugcuuccugcucugcgucgugcugcugggcuucaucaugugggcgugccagaaggggaacauccggugcaacaucugcaucuga

SEQ ID NO: 8785 - RNA, 1701 nt, Artificial Sequence
  derived and/or modified CDS sequence (AUadapt) from InfluenzaA__AFG98918__HA
augaagaccaucaucgcccugucguacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagucguccagcaccggcaagaucugcaacaacccccaccgcauccuggacgggaucaacugcacccugaucgacgcccuccugggcgacccccacugcgacggcuuccagaacgagaagugggaccuguucguggagcgguccaaggccuucucgaacugcuaccccuacgacgugccggacuacgccucccuccgcagccuggucgcguccucggggacgcuggaguucaucaacgagggcuucaacuggaccggggugacccagaacggcggguccaacgccugcaagcggggccccgaccgcggcuucuucagccggcucaacuggcuguacaaguccgggucgaccuaccccgugcugaacgucacgaugcccaacaacgacaacuucgacaagcucuacaucuggggcgugcaccacccguccaccgaccaggagcagaccaaccuguacgugcaggccagcgggcgcgucaccguguccacgaagcggucgcagcagaccaucauccccaacaucggcucccgccccugggugcggggccugucgagccgcaucuccaucuacuggaccaucgucaagcccggggacauccucgugaucaacucgaacggcaaccugaucgccccgcggggguacuucaagaugcgcaccggcaaguccagcaucaugcgguccgacgcgcccaucgggacgugcaucucggagugcaucacccccaacggcuccauccccaacgacaagccguuccagaacgugaacaagaucaccuacggcgccugccccaaguacgucaagcagaacacccugaagcucgccacggggaugcgcaacgugcccgagaagcagacccggggcaucuucggggccaucgccggcuucaucgagaacgggugggagggcaugaucgacggcugguacggguuccgccaccagaacagcgagggcaccgggcaggcggccgaccugaaguccacccaggccgccaucgaccagaucaacggcaagcugaaccgggugaucgagaagacgaacgagaaguuccaccagaucgagaaggaguucucggaggucgaggggcgcauccaggaccucgagaaguacguggaggacaccaagaucgaccugugguccuacaacgccgagcugcucguggcgcuggagaaccagcacaccaucgaccugaccgacagcgagaugaacaagcuguucgagaagacgcggcgccagcuccgggagaacgccgaggacaugggcaacggcugcuucaagaucuaccacaagugcgacaacgccugcaucggguccauccgcaacggcaccuacaaccacgacgucuaccgcgacgaggcccugaacaaccgguuccagaucaaggggguggagcucaagucgggcuacaaggacuggauccuguggaucuccuucgccaucagcugcuuccugcucugcgucgugcugcugggcuucaucaugugggcgugccagaaggggaacauccgcugcaacaucugcaucuga

SEQ ID NO: 8786 - RNA, 1701 nt, Artificial Sequence
  derived and/or modified CDS sequence (AUadapt) from InfluenzaA__AFG98929__HA
augaagaccgugaucgcccugucguacaucuucugccucguccugggccaggaccugcccgggaacgacaacuccaccgccacgcucugccugggccaccacgcggugccgaacgggacccuggugaagaccaucaccaacgaccagaucgaggucacgaacgccaccgagcucgugcagagcuccucgaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgucccggacuacgccucccuccgcucgcugguggcguccagcgggacgcuggaguucaucaacgagggcuucaacuggaccggggugacccagaacggcggguccaacgccugcaagcggggccccgacaucggcuucuucucgcgccucaacuggcuguacaaguccgggagcaccuaccccguccugaacgugacgaugcccaacaacgacaacuucgacaagcucuacaucuggggcgugcaccacccguccaccgaccaggagcagaccaaccuguacguccaggccucggggcgggugaccguguccacgaagcgcagccagcagaccaucauccccaacaucggcucccggcccuggguccgcggccugucgagccggaucuccaucuacuggaccaucgugaagcccggggacauccucgugaucaacucgaacggcaaccugaucgccccgcgcggguacuucaagaugcggaccggcaaguccagcaucaugcgcuccgacgcgcccaucgggacgugcaucucggagugcaucacccccaacggcuccauccccaacgacaagccguuccagaacgucaacaagaucaccuacggcgccugccccaaguacgugaagcagaacacccugaagcucgccacggggaugcggaacgugcccgagaagcagacccgcggcaucuucggggccaucgccggcuucaucgagaacgggugggagggcaugaucgacggcugguacggguuccggcaccagaacagcgagggcaccgggcaggcggccgaccugaaguccacccaggccgccaucgaccagaucaacggcaagcugaaccgcgucaucgagaagacgaacgagaaguuccaccagaucgagaaggaguucucggagguggaggggcggauccaggaccucgagaaguacguggaggacaccaagaucgaccugugguccuacaacgccgagcugcucgucgcgcuggagaaccagcacaccaucgaccugaccgacagcgagaugaacaagcuguucgagaagacgcgccggcagcuccgcgagaacgccgaggacaugggcaacggcugcuucaagaucuaccacaagugcgacaacgccugcaucggguccauccggaacggcaccuacaaccacgacguguaccgcgacgaggcccugaacaaccgcuuccagaucaagggggucgagcucaagucgggcuacaaggacuggauccuguggaucuccuucgccaucagcugcuuccugcucugcguggugcugcugggcuucaucaugugggcgugccagaaggggaacauccggugcaacaucugcaucuga

SEQ ID NO: 8787 - RNA, 1701 nt, Artificial Sequence
  derived and/or modified CDS sequence (AUadapt) from InfluenzaA__AFG98940__HA
augaagaccaucaucgcccugucguacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccucgaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgugccggacuacgccucccuccgcucgcuggucgcguccagcgggacgcuggaguucaucaacgagggcuucaacuggaccggggugacccagaacggcggguccaacgccugcaagcggggccccgacucgggcuucuucucccgccucaacuggcuguacaagagcggguccaccuaccccgugcugaacgucacgaugcccaacaaggacaacuucgacaagcucuacaucuggggcgugcaccacccgucgaccgaccaggagcagaccaaccuguacgugcaggccuccgggcgggucaccgugagcacgaagcgcucccagcagaccaucauccccaacaucggcucgcggcccugggugcgcggcaugagcucccggaucucgaucuacuggaccaucgucaagcccggggacauccuggugaucaacuccaacggcaaccucaucgccccgcgcggguacuucaagaugcggaccggccgcagcuccaucaugcggucggacgcgcccaucgggacgugcaucuccgagugcaucacccccaacggcagcauccccaacgaccgcccguuccagaacgugaacaagaucaccuacggcgccugccccaaguacgucaagcagaacacccugaagcuggccacggggaugcggaacgugcccgagaagcagacccgcggcaucuucggggccaucgccggcuucaucgagaacgggugggagggcaugaucgacggcugguacggguuccggcaccagaacuccgagggcaccgggcaggcggccgaccucaagucgacccaggccgccaucgaccagaucaacggcaagcugaaccgcgugaucgagaagacgaacgagaaguuccaccagaucgagaaggaguucuccgaggucgaggggcggauccaggaccuggagaaguacguggaggacaccaagaucgaccucuggagcuacaacgccgagcugcugguggcgcucgagaaccagcacaccaucgaccugaccgacuccgagaugaacaagcuguucgagaagacgcgccggcagcuccgcgagaacgccgaggacaugggcaacggcugcuucaagaucuaccacaagugcgacaacgccugcaucgagucgauccgcaacgggaccuacaaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggcgugccagaagggcaacauccggugcaacaucugcaucuga

SEQ ID NO: 8788 - RNA, 1701 nt, Artificial Sequence
  derived and/or modified CDS sequence (AUadapt) from InfluenzaA__AFG98962__HA
augaagaccaucaucgcccugucguacaucuucugccucgugcuggcccaggaccugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggaagaucugcaacaacccccaccgcauccuggacggcaucaacugcacccugaucgacgcccuccugggggacccccacugcgacggcuuccagaacgagaagugggaccuguucguggagcgguccaaggccuucucgaacugcuaccccuacgacgugccggacuacgcgucccuccgcagccuggucgccuccucgggcacgcuggaguucaucaacgagggguucaacuggaccggcgugacccagaacgggggcuccaacgccugcaagcgggggcccgacagcggcuucuucucccgccucaacuggcuguacaagucgggcuccaccuaccccgugcugaacgucacgaugcccaacaacgacaacuucgacaagcucuacaucuggggcgugcaccacccgagcaccgaccaggagcagaccaaccuguacgugcaggccuccgggcgggucaccgugucgacgaagcgcucccagcagaccaucauccccaacguggggagccggcccuggguccgcggccugucgucccggaucagcaucuacuggaccaucgugaagcccggcgacauccucgugaucaacuccaacgggaaccugaucgcgccgcgcggcuacuucaagaugcggaccggcaagucguccaucaugcgcagcgacgcccccaucgggacgugcuccucggagugcaucacccccaacggguccauccccaacgacaagccguuccagaacgucaacaagaucaccuacggcgccugccccaaguacgugaagcagaacacccugaagcucgccacgggcaugcggaacgugcccgagaagcagacccgcgggaucuucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcugaaccgcgucaucgagaagacgaacgagaaguuccaccagaucgagaaggaguucucggagguggagggccggauccaggaccucgagaaguacguggaggacaccaagaucgaccugugguccuacaacgcggagcugcucgucgcccuggagaaccagcacaccaucgaccugaccgacagcgagaugaacaagcuguucgagaagacgcgccggcagcuccgcgagaacgccgaggacauggggaacggcugcuucaagaucuaccacaagugcgacaacgccugcaucggcuccauccggaacgggaccuacgaccacgacguguaccgcgacgaggcccugaacaaccgcuuccagaucaagggcgucgagcucaagucgggguacaaggacuggauccuguggaucuccuucgcgaucagcugcuuccugcucugcguggugcugcugggcuucaucaugugggccugccagaagggcaacauccggugcaacaucugcaucuga

SEQ ID NO: 8789 - RNA, 1701 nt, Artificial Sequence
  derived and/or modified CDS sequence (AUadapt) from InfluenzaA__AFG98973__HA
augaagaccaucaucgcccugucguacaucuucugccucgugcugggccaggacuucccccgcaacgacaacuccaccgccacgcugugccucgggcaccacgcggucccgaacggcacccuggugaagaccaucaccaacgaccagaucgaggugacgaacgccaacgagcugguccagucguccagcaccgggaagaucugcaacaacccccaccggauccucgacggcauggacugcacccugaucgacgcccugcucggggacccccacugcgacggccugcagaacgagaccugggaccuguucguggagcgcuccaaggccuucucgaacugcuaccccuacgacgugccggacuacgccucccuccggagccuggucgcguccucgggcacgcuggaguucaucaacgagggguucaccuggaccggcgugacccagaacgggggcuccaacgccugcaagcgcgggcccgaccggggcuucuucucgcgccucaacuggcuguacaaguccggcaacacguaccccgugcugaacgucaccaugcccaacaacgacaacuucgacaagcucuacaucuggggcgugcaccacccgagcaccgaccaggaccagaccucccuguacgugcaggccucggggcgggucacgguguccaccaagcgcagccagcagaccgugauccccaacaucgggccccggcccuggguccgcggccuguccucgggcaucagcaucuacuggaccaucgugaagccgggggacauccuccugaucaacuccaacggcaaccugaucgcgccccggggguacuucaagaugcgcacgggcaagucguccaucaugcggucggacgcccccaucgggaccugcaucuccgagugcaucacccccaacggcagcaucccgaacgacaagcccuuccagaacgugaacaagaucaccuacggcgccugccccaaguacgucaagcagaacacgcucaagcuggccaccgggaugcgcaacgugcccgagaagcagacccggggcaucuucggggccaucgccggcuucaucgagaacgggugggagggcaugaucgacggcugguacggguuccgccaccagaacuccgagggcaccgggcaggcggccgaccucaagucgacgcaggccgccaucgaccagaucaacggcaagcugaaccgggugaucgagaagaccaacgagaaguuccaccagaucgagaaggaguucuccgaggucgaggggcgcauccaggaccuggagaaguacguggaggacaccaagaucgaccuguggagcuacaacgccgagcuccugguggcgcuggagaaccagcacaccaucgaccucacggacuccgagaugaacaagcuguucgagaagacccggcgccagcugcgggagaacgccgaggacaugggcaacggcugcuucaagaucuaccaccgcugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggcuucaucaugugggcgugccagaaggggaacauccggugcaacaucugcaucuga

SEQ ID NO: 8790 - RNA, 1701 nt, Artificial Sequence
  derived and/or modified CDS sequence (AUadapt) from InfluenzaA__AFG98984__HA
augaagaccaucaucgcccugucguacaucuucugccucgugcugggccaggacuucccccgcaacgacaacuccaccgccacgcugugccucgggcaccacgcggucccgaacggcacccuggugaagaccaucaccaacgaccagaucgaggugacgaacgccaccgagcugguccagucguccagcaccgggaagaucugcaacaacccccaccggauccucgacggcauggacugcacccugaucgacgcccugcucggggacccccacugcgacggccugcagaacgagacgugggaccuguucguggagcgcuccaaggccuucucgaacugcuaccccuacgacgugccggacuacgccucccuccggagccuggucgcguccucgggcacccuggaguucaucaacgagggguucaccuggaccggcgugacgcagaacgggggcuccaacgccugcaagcgcgggcccgaccggggcuucuucucgcgccucaacuggcuguacaaguccggcaacaccuaccccgugcugaacgucaccaugcccaacaacgacaacuucgacaagcucuacaucuggggcgugcaccacccgagcaccgaccaggaccagacgucccuguacgugcaggccucggggcgggucaccguguccaccaagcgcagccagcagaccgugauccccaacaucgggccccggcccuggguccgcggccuguccucgggcaucagcaucuacuggacgaucgugaagccgggggacauccuccugaucaacuccaacggcaaccugaucgcgccccggggguacuucaagaugcgcaccggcaagucguccaucaugcggucggacgcccccaucgggaccugcaucuccgagugcaucacccccaacggcagcaucccgaacgacaagcccuuccagaacgugaacaagaucacguacggcgccugccccaaguacgucaagcagaacacccucaagcuggccaccgggaugcgcaacgugcccgagaagcagacccggggcaucuucggggccaucgccggcuucaucgagaacgggugggagggcaugaucgacggcugguacggguuccgccaccagaacuccgagggcacggggcaggcggccgaccucaagucgacccaggccgccaucgaccagaucaacggcaagcugaaccgggugaucgagaagaccaacgagaaguuccaccagaucgagaaggaguucuccgaggucgaggggcgcauccaggaccuggagaaguacguggaggacaccaagaucgaccuguggagcuacaacgccgagcuccugguggcgcuggagaaccagcacacgaucgaccucaccgacuccgagaugaacaagcuguucgagaagacccggcgccagcugcgggagaacgccgaggacaugggcaacggcugcuucaagaucuaccaccgcugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggcuucaucaugugggcgugccagaaggggaacauccggugcaacaucugcaucuga

SEQ ID NO: 8791 - RNA, 1704 nt, Artificial Sequence
  derived and/or modified CDS sequence (AUadapt) from InfluenzaA__AFG98995__HA
augaagaccaucaucgcccugucguacaucuucugccucguguucgcccaggaccugcccggcaacgacaacaacuccaccgcgacgcugugccucgggcaccacgccgucccgaacggcacccuggugaagaccaucaccaacgaccagaucgaggugacgaacgccaccgagcugguccagucguccagcaccgggaagaucugcaacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccaacgccugcaagcgggggcccgacaucggcuucuucagccgccugaacuggcucuacaaguccggcucgaccuaccccgugcagaacgucacgaugcccaacaacgacaacuccgacaagcuguacaucuggggcgugcaccacccgucgaccgacaaggagcagaccgaccuguacgugcaggccuccgggaaggucaccgugagcacgaagcggucccagcagaccaucauccccaacguggggucgcgccccuggguccggggccucagcucccgcaucucgaucuacuggaccaucgugaagcccggcgacauccuggugaucaacuccaacgggaaccugaucgcgccgcggggcuacuucaagaugcgcaccggcaagagcuccaucaugcggucggacgcccccaucgggacgugcuccucggagugcaucacccccaacggguccauccccaacgacaagccguuccagaacgucaacaagaucaccuacggcgccugccccaaguacgugaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucggcuccauccgcaacgggaccuacgaccacgacguguaccgggacgaggcccucaacaaccgcuuccagaucaagggcgucgagcucaagucgggguacaaggacuggauccuguggaucuccuucgcgaucagcugcuuccugcugugcguggugcugcucggcuucaucaugugggccugccagaagggcaacauccgcugcaacaucugcaucuga

SEQ ID NO: 8792 - RNA, 1701 nt, Artificial Sequence
  derived and/or modified CDS sequence (AUadapt) from InfluenzaA__AFG99006__HA
augaagaccaucaucgcccugucguacaucuucugccucgugcugggccaggacuucccccgcaacgacaacuccaccgccacgcugugccucgggcaccacgcggucccgaacggcacccuggugaagaccaucaccaacgaccagaucgaggugacgaacgccaccgagcugguccagucguccagcaccgggaagaucugcaacaacccccaccggauccucgacggcauggacugcacccugaucgacgcccugcucggggacccccacugcgacggccugcagaacgagacgugggaccuguucguggagcgcuccaaggccuucucgaacugcuaccccuacgacgugccggacuacgccucccuccggagccuggucgcguccucgggcacccuggaguucaucaacgagggguucaccuggaccggcgugacgcagaacgggggcuccaacgccugcaagcgcgggcccgaccggggcuucuucucgcgccucaacuggcuguacaaguccggcaacaccuaccccgugcugaacgucaccaugcccaacaacgacaacuucgacaagcucuacaucuggggcgugcaccacccgagcaccgaccaggaccagacgucccuguacgugcaggccucgggccgggucaccguguccaccaagcgcagccagcagaccgugauccccaacaucgggccccggcccuggguccgcggccuguccucgcggaucagcaucuacuggacgaucgugaagccgggcgacauccuccugaucaacuccaacgggaaccugaucgcgccccgcggcuacuucaagaugcggaccggcaagucguccaucaugcgcucggacgcccccaucgggaccugcaucuccgagugcaucacccccaacgggagcaucccgaacgacaagcccuuccagaacgugaacaagaucacguacggggccugccccaaguacgucaagcagaacacccucaagcuggccaccggcaugcggaacgugcccgagaagcagacccgcgggaucuucggcgccaucgccggguucaucgagaacggcugggaggggaugaucgacggcugguacggcuuccggcaccagaacuccgaggggacgggccaggcggccgaccucaagucgacccaggccgccaucgaccagaucaacgggaagcugaaccgcgugaucgagaagaccaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacacgaucgaccucaccgacuccgagaugaacaagcuguucgagaagacccgccggcagcugcgcgagaacgccgaggacauggggaacggcugcuucaagaucuaccaccgcugcgacaacgccugcaucggcucgauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggcgugccagaagggcaacauccgcugcaacaucugcaucuga

SEQ ID NO: 8793 - RNA, 1701 nt, Artificial Sequence; identical to SEQ ID NO: 1009
  derived and/or modified CDS sequence (AUadapt) from InfluenzaA__AFG99017__HA

SEQ ID NO: 8794 - RNA, 1701 nt, Artificial Sequence
  derived and/or modified CDS sequence (AUadapt) from InfluenzaA__AFG99028__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcggcaacccccaccgcauccucgacgggaucaacugcacccugaucgacgcccugcucggcgacccccacugcgacggcuuccagaacgagaagugggaccuguucguggagcgguccaaggccuucucgaacugcuaccccuacgacgugccggacuacgcgucccugcgcagccucgucgccuccucggggacgcuggaguucaucaacgagggcuucaacuggaccggggugacccagaacggcggguccagcgccugcaagcggggccccgacaacggcuucuucucccgccugaacuggcucuacaagucgggguccaccuaccccgugcagaacgucacgaugcccaacaacgacaacucggacaagcuguacaucuggggcgugcaccacccguccaccgacaaggagcagaccgaccuguacgugcaggccagcgggaaggucaccguguccacgaagcggucgcagcagaccgugauccccaacgucggcagccgccccugggugcggggccucuccucgcgcguguccaucuacuggaccaucgucaagcccggggacauccuggugaucaacagcaacggcaaccugaucgcgccgcggggguacuucaagaugcgcaccggcaaguccucgaucaugcgguccgacgcccccaucgggacgugcucguccgagugcaucacccccaacggcagcauccccaacgacaagccguuccagaacgugaacaagaucaccuacggcgccugccccaaguacgucaagcagaacacccucaagcuggccacggggaugcgcaacgugcccgagaagcagacccggggcaucuucggggccaucgcgggcuucaucgagaacgggugggagggcaugaucgacggcugguacggguuccgccaccagaacuccgagggcaccgggcaggccgccgaccucaagucgacccaggccgccaucgaccagaucaacggcaagcugaaccgggugaucgagaagacgaacgagaaguuccaccagaucgagaaggaguucuccgaggucgaggggcgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacaugggcaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgugcugcucggcuucaucaugugggccugccagaaggggaacauccgcugcaacaucugcaucuga

SEQ ID NO: 8795 - RNA, 1701 nt, Artificial Sequence
  derived and/or modified CDS sequence (AUadapt) from InfluenzaA__AFG99039__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccagcgccugcaagcgggggcccgacaacggcuucuucucccgccugaacuggcucuacaagucgggcuccaccuaccccgugcagaacgucgccaugcccaacaacgacaacucggacaagcuguacaucuggggcgugcaccacccguccacggacaaggagcagaccgaccuguacgugcaggcgagcggcaaggucaccguguccaccaagcggucgcagcagacggugauccccaacgucgggagccgccccugggugcggggccucuccucgcgcguguccaucuacuggaccaucgucaagcccggcgacauccuggugaucaacagcaacgggaaccugaucgccccgcggggcuacuucaagaugcgcaccgggaaguccucgaucaugcgguccgacgcccccaucgggaccugcucguccgagugcaucacgcccaacgggagcauccccaacgacaagccguuccagaacgugaacaagaucaccuacggcgccugccccaaguacgucaagcagaacacccucaagcuggccaccggcaugcgcaacgugcccgagaagcagacgcgggggaucuucggcgcgaucgccggguucaucgagaacggcugggaggggaugaucgacggcugguacggcuuccgccaccagaacuccgaggggaccggccaggccgccgaccucaagucgacccaggccgcgaucgaccagaucaacgggaagcugaaccgggugaucgagaagaccaacgagaaguuccaccagaucgagaaggaguucuccgaggucgagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagaagacccggcgccagcugcgggagaacgccgaggacauggggaacggcugcuucaagaucuaccacaagugcgacaacgccugcaucggcucgauccgcaacgggacguacgaccacgacguguaccgggacgaggcgcucaacaaccgcuuccagaucaagggcguggagcugaaguccggguacaaggacuggauccuguggaucagcuucgccaucuccugcuuccuccugugcgucgugcugcucggcuucaucaugugggccugccagaagggcaacauccgcugcaacaucugcaucuga

SEQ ID NO: 8796 - RNA, 1701 nt, Artificial Sequence; identical to SEQ ID NO: 1009
  derived and/or modified CDS sequence (AUadapt) from InfluenzaA__AFG99050__HA

SEQ ID NO: 8797 - RNA, 1701 nt, Artificial Sequence
  derived and/or modified CDS sequence (AUadapt) from InfluenzaA__AFG99061__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccagcgccugcaagcgggggcccgacaacggcuucuucucccgccugaacuggcucuacaagucgggcuccaccuaccccgugcagaacgucacgaugcccaacaacgacaacucggacaagcuguacaucuggggcgugcaccacccguccaccgacaaggagcagaccgaccuguacgugcaggccagcgggaaggucaccguguccacgaagcggucgcagcagaccgugauccccaacgucgggagccgccccugggugcggggccucuccucgcgcguguccaucuacuggaccaucgucaagcccggcgacauccuggugaucaacagcaacgggaaccugaucgcgccgcggggcuacuucaagaugcgcaccgggaaguccucgaucaugcgguccgacgcccccaucggcacgugcucguccgagugcaucacccccaacgggagcauccccaacgacaagccguuccagaacgugaacaagaucaccuacggcgccugccccaaguacaucaagcagaacacccucaagcuggccacgggcaugcgcaacguccccgagaagcagacccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaacaaggugaucgagaagacgaacgagaaguuccaccagaucgagaaggaguucuccgagguggagggccggauccaggaccuggagaaguacgucgaggacaccaagaucgaccuguggagcuacaacgcggagcuccugguggcccuggagaaccagcacaccaucgaccucaccgacuccgagaugaacaagcuguucgagaagacgcgccggcagcugcgcgagaacgccgaggacauggggaacggcugcuucaagaucuaccacaagugcgacaacgccugcaucggcucgauccggaacgggaccuacgaccacgacgucuaccgcgacgaggcccucaacaaccgguuccagaucaagggcguggagcugaaguccggguacaaggacuggauccuguggaucagcuucgcgaucuccugcuuccuccugugcgugguccugcucggcuucaucaugugggccugccagaagggcaacauccgcugcaacaucugcaucuga

SEQ ID NO: 8798 - RNA, 1701 nt, Artificial Sequence
  derived and/or modified CDS sequence (AUadapt) from InfluenzaA__AFG99072__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaagaacugcacccugaucgacgcccugcucggggacccccacugcgacggcuuccagaacgagaagugggaccuguucguggagcgguccaaggccuucucgaacugcuaccccuacgacgugccggacuacgcgucccugcgcucgcucgucgccuccagcggcacgcuggaguucaucaacgagggguucaacuggaccggcgugacccagaacgggggcuccucggccugcaagcgggggcccgacaacggcuucuucucccgccugaacuggcucuacaagagcggcuccaccuaccccgugcagaacgucacgaugcccaacaacgacaacucggaccggcuguacaucuggggcgugcaccacccguccaccgacaaggagcagaccgaccuguacgugcaggccucggggaaggucaccguguccacgaagcgcagccagcagaccgugauccccaacgucgggucgcggcccugggugcgcggccucuccucgcggguguccaucuacuggaccaucgucaagcccggcgacauccuggugaucaacagcaacgggaaccugaucgcgccgcgcggcuacuucaagaugcggaccgggaaguccucgaucaugcgcuccgacgcccccaucggcacgugcagcuccgagugcaucacccccaacgggucgauccccaacgacaagccguuccagaacgugaacaagaucaccuacggcgccugccccaaguacgucaagcagaacacccucaagcuggccacgggcaugcggaacgugcccgagaagcagacccgcgggaucuucggcgccaucgcgggguucaucgagaacggcugggaggggaugaucgacggcugguacggcuuccggcaccagaacuccgaggggaccggccaggccgccgaccucaagucgacccaggccgccaucgaccagaucaacgggaagcugaaccgcgugaucgagaagacgaacgagaaguuccaccagaucgagaaggaguucuccgaggucgagggccggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgccggcagcugcgcgagaacgccgaggacauggggaacggcugcuucaagaucuaccacaagugcgacaacgccugcaucggcucgauccggaacgggaccuacaaccacgacguguaccgcgacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccggugcaacaucugcaucuga

SEQ ID NO: 8799 - RNA, 1701 nt, Artificial Sequence
  derived and/or modified CDS sequence (AUadapt) from InfluenzaA__AFG99083__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccagcgccugcaagcgggggcccgacaagggcuucuucucccgccugaacuggcucuacaagucgggcuccaccuaccccgugcagaacgucacgaugcccaacaacgacaacagcgacaagcuguacaucuggggcgugcaccacccguccaccgacaaggagcagaccgaccuguacgugcaggccucggggaaggucaccguguccacgaagcggagccagcagaccgugauccccaacgucgggucgcgccccugggugcggggccucuccagccgcguguccaucuacuggaccaucgucaagcccggcgacauccuggugaucaacucgaacgggaaccugaucgcgccgcggggcuacuucaagaugcucaccgggaaguccagcaucaugcgcuccgacgcccccaucggcacgugcucguccgagugcaucacccccaacgggagcauccccaacgacaagccguuccagaacgugaacaagaucaccuacggcgccugccccaaguacgucaagcagaacacccugaagcuggccacgggcaugcggaacgugcccgagaagcagacccgcgggaucuucggcgccaucgcgggguucaucgagaacggcugggaggggaugaucgacggcugguacggcuuccggcaccagaacuccgaggggaccggccaggccgccgaccucaagucgacccaggccgccaucgaccagaucaacgggaagcugaaccgcgugaucgagaagacgaacgagaaguuccaccagaucgagaaggaguucuccgaggucgagggccggauccacgaccuggagaaguacguggaggacaccaagaucgaccucuggagcuacaacgcggagcugcuggucgcccucgagaaccagcacaccaucgaccugaccgacuccgagaugaacaagcuguucgagaagacgcgccggcagcuccgcgagaacgccgaggacauggggaacggcugcuucaagaucuaccacaagugcgacaacgccugcaucggcucgauccggaacgggaccuacgaccacgacguguaccgcgacgaggcccugaacaaccgguuccagaucaagggcguggagcugaaguccggguacaaggacuggauccucuggaucagcuucgcgaucuccugcuuccugcugugcgucgugcuccugggcuucaucaugugggccugccagaagggcaacauccgcugcaacaucugcaucuga

SEQ ID NO: 8800 - RNA, 1701 nt, Artificial Sequence
  derived and/or modified CDS sequence (AUadapt) from InfluenzaA__AFG99094__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcucgcucgucgccuccagcggcacgcuggaguucaucaacgagggguucaacuggaccggcgugacccagaacgggggcuccggggccugcaagcggggccccgacaacggcuucuucucgcgccugaacuggcucuacaaguccgggagcaccuaccccgugcagaacgucacgaugcccaacaacgacaacuccgacaagcuguacaucuggggcgugcaccacccgucgaccgacaaggagcagaccgaccuguacgugcaggccuccgggaaggucaccgugucgacgaagcggucccagcagaccgugauccccaacgucggcagccgccccugggugcggggccucucgucccgcgugucgaucuacuggaccaucgucaagcccggggacauccuggugaucaacuccaacggcaaccugaucgcgccgcggggguacuucaagaugcgcaccggcaagagcuccaucaugcggucggacgcccccaucgggacgugcuccagcgagugcaucacccccaacggcuccauccccaacgacaagccguuccagaacgugaacaagaucaccuacggcgccugccccaaguacgucaagcagaacacccucaagcuggccacggggaugcgcaacgugcccgagaagcagacccggggcaucuucggggccaucgcgggcuucaucgagaacgggugggagggcaugaucgacggcugguacggguuccgccaccagaacucggagggcaccgggcaggccgccgaccugaaguccacccaggccgccaucgaccagaucaacggcaagcucaaccgggugaucgagaagacgaacgagaaguuccaccagaucgagaaggaguucucggaggucgaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacggcugcuucaagaucuaccacaagugcgacaacgccugcaucggguccauccgcaacggcaccuacgaccacgacguguaccgggacgaggcccucaacaaccgcuuccagaucaaggggguggagcucaagucgggcuacaaggacuggauccuguggaucuccuucgcgaucagcugcuuccugcugugcgucgugcugcucggcuucaucaugugggccugccagaaggggaacauccgcugcaacaucugcaucuga

SEQ ID NO: 8801 - RNA, 1701 nt, Artificial Sequence
  derived and/or modified CDS sequence (AUadapt) from InfluenzaA__AFG99116__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccucguccggcacgcuggaguucaucaacgagagcuucaacuggaccggggugacccaguccggcgggagcuacgccugcaagcgcggcuccgacaacucguucuucucccggcugaacuggcucuacgagagcgaguccaaguaccccguccugaacgugaccaugcccaacaacgggaacuucgacaagcuguacaucuggggcgugcaccaccccagcacggacaaggagcagaccaaccucuacguccgcgccucgggccgggugaccguguccaccaagcgcagccagcagacgaucaucccgaacaucgggucccggcccuggguccgcggccugagcucccggaucucgaucuacuggaccaucgugaagcccggggacauccugcucaucaacuccaacggcaaccugaucgcgccccgcggcuacuucaagauccggaccggcaagagcuccaucaugcgcagcgacgccccgaucgggaccugcuccucggagugcaucacgcccaacggguccauccccaacgacaagcccuuccagaacgugaacaagaucaccuacggcgccugcccgaaguacgucaagcagaacacccugaagcucgccaccgggaugcggaacgugcccgagaagcagacgcgcggcaucuucggcgccaucgcgggguucaucgagaacggcugggaggggaugguggacggcugguacggguuccggcaccagaacagcgagggcaccggccaggccgccgaccugaaguccacccaggccgccaucgaccagaucaacgggaagcugaaccgcgucaucgagaagaccaacgagaaguuccaccagaucgagaaggaguucagcgagguggagggccggauccaggaccucgagaaguacguggaggacacgaagaucgaccugugguccuacaacgcggagcugcucgucgcccuggagaaccagcacaccaucgaccugaccgacucggagaugaacaagcuguucgagaagacccgccggcagcuccgcgagaacgccgaggacauggggaacggcugcuucaagaucuaccacaagugcgacaacgccugcaucggguccauccgcaacggcacguacgaccacgacguguaccgggacgaggcccugaacaaccgcuuccagaucaagggcgucgagcucaagagcggguacaaggacuggauccuguggaucagcuucgcgaucuccugcuuccugcucugcguggugcugcugggcuucaucaugugggccugccagaaggggaacauccggugcaacaucugcaucuga

SEQ ID NO: 8802 - RNA, 1701 nt, Artificial Sequence
  derived and/or modified CDS sequence (AUadapt) from InfluenzaA__AFG99127__HA
augaagaccaucaucgcccugucguacauccucugccugguguucgcccagaaccugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugguggacgcccuccugggggacccccacugcgacggcuuccagaacgagaagugggaccuguucguggagcgcagcaaggccuucuccaacugcuaccccuacgacgucccggacuacgcgucgcuccggucccugguggccagcuccggcacgcuggaguucaucaacgagucguucaacuggaccggggugacccaguccggcgggagcuacgccugcaagcgcggcuccgacaacagcuucuucucccggcucaacuggcuguacgagucggaguccaaguaccccguccugaacgugaccaugcccaacaacgggaacuucgacaagcucuacaucuggggcgugcaccaccccagcacggacaaggagcagaccaaccuguacguccgcgccucgggccgggugaccguguccaccaagcgcagccagcagacgaucaucccgaacaucgggucccggcccuggguccgcggccugagcucccggaucucgaucuacuggaccaucgugaagcccggggacauccuccugaucaacuccaacggcaaccugaucgcgccccgcggcuacuucaagauccggaccggcaagagcuccaucaugcgcucggacgccccgaucgggaccugcuccagcgagugcaucacgcccaacggguccauccccaacgacaagcccuuccagaacgugaacaagaucaccuacggcgccugcccgaaguacgucaagcagaacacccucaagcuggccaccgggaugcggaacgugcccgagaagcagacgcgcggcaucuucggcgccaucgcgggguucaucgagaacggcugggaggggaugguggacggcugguacggguuccggcaccagaacagcgagggcaccggccaggccgccgaccugaaguccacccaggccgccaucgaccagaucaacgggaagcucaaccgcgucaucgagaagaccaacgagaaguuccaccagaucgagaaggaguucucggagguggagggccggauccaggaccuggagaaguacguggaggacacgaagaucgaccugugguccuacaacgcggagcuccuggucgcccuggagaaccagcacaccaucgaccucaccgacagcgagaugaacaagcuguucgagaagacccgccggcagcugcgcgagaacgccgaggacauggggaacggcugcuucaagaucuaccacaagugcgacaacgccugcaucggguccauccgcaacggcacguacgaccacgacguguaccgggacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagaaggggaacauccggugcaacaucugcaucuga

SEQ ID NO: 8803 - RNA, 1701 nt, Artificial Sequence
  derived and/or modified CDS sequence (AUadapt) from InfluenzaA__AFG99138__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccucguccggcacgcuggaguucaucaacgagagcuucaacuggaccggggugacccaguccggcgggucguccgccugcaagcgcggcagcgacaacuccuucuucagccggcugaacuggcucuacgaguccgagucgaaguaccccguccugaacgugaccaugcccaacaacgggaacuucgacaagcuguacaucuggggcgugcaccaccccagcacggacaaggagcagaccaaccucuacguccgcgccuccggccgggugaccgugucgaccaagcgcaaccagcagacggucaucccgaacaucgggucccggcccugggugcgcggccugagcucccggaucagcaucuacuggaccaucgugaagcccggggacauccugcucaucaacuccaacggcaaccugaucgcgccccgcggcuacuucaagauccggaacggcaagucguccaucaugcgcagcgacgccccgaucgggaccugcuccucggagugcaucacccccaacggguccauccccaacgacaagcccuuccagaacgucaacaagaucacguacggcgccugcccgaaguacgugaagcagaacacccugaagcucgccaccgggaugcggaacgugcccgagaagcagacccgcggcaucuucggcgccaucgcgggguucaucgagaacggcugggaggggauggucgacggcugguacggguuccggcaccgcaacagcgagggcacgggccaggccgccgaccugaaguccacccaggccgccaucgaccagaucaacgggaagcugaaccgggugaucgagaagaccaacgagaaguuccaccagaucgagaaggaguucagcgagguggagggccgcauccaggaccucgagaaguacgucgaggacaccaagaucgaccugugguccuacaacgcggagcugcucguggcccuggagaaccagcacacgaucgaccugaccgacucggagaugaacaagcuguucgagaagacccggcgccagcuccgcgagaacgccgaggacauggggaacggcugcuucaagaucuaccacaagugcgacaacgccugcaucggguccauccggaacggcaccuacgaccacgacgucuaccgcgacgaggcccugaacaaccgguuccagaucaagggcguggagcucaagagcggguacaaggacuggauccuguggaucagcuucgcgaucuccugcuuccugcucugcgugguccugcugggcuucaucaugugggccugccagaaggggaacauccgcugcaacaucugcaucuga

SEQ ID NO: 8804 - RNA, 1701 nt, Artificial Sequence
  derived and/or modified CDS sequence (AUadapt) from InfluenzaA__AFG99149__HA
augaagaccaucaucgcccugucguacauccucugccugguguucgcccagaaccugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacgagaagugggaccuguucguggagcgcucgcgggccuucuccaacugcuaccccuacgacgugccggacuacgcgagccuccgcucccuggucgccucguccggcacgcuggaguucaucaacgagggguucaacuggaccggcgugacccagagcgggggcuccuacgccugcaagcgggggucggacaacuccuucuucagccgccucaacuggcuguacgaguccgagagcaaguaccccgugcugaacgucaccaugcccaacaacggcaaguucgacaagcucuacaucuggggcgugcaccaccccuccacggacaaggagcagaccaaccuguacgugcgggccucggggcgcgucaccgugagcaccaagcggucccagcagacggugaucccgaacaucggcucgcgccccuggguccgggggcuguccagccgcaucuccaucuacuggaccaucgugaagcccggcgacauccuccugaucaacucgaccggcaaccugaucgcgccccggggguacuucaagauccgcaccggcaaguccagcaucaugcgguccgacgccccgaucgggacgugcucguccgagugcaucacccccaacggcagcauccccaacgacaagcccuuccagaacgugaacaagaucaccuacggggccugcccgcgcuacgucaagcagaacacccucaagcuggccacgggcaugcggaacgugcccgagaagcagacccgcggcaucuucggggccaucgcgggcuucaucgagaacgggugggagggcaugguggacgggugguacggcuuccggcaccagaacuccgagggcaccgggcaggccgccgaccugaaguccacccaggccgccaucgaccagaucaacggcaagcucaaccgcgucaucgagaagacgaacgagaaguuccaccagaucgagaaggaguucuccgagguggaggggcggauccaggaccuggagaaguacguggaggacaccaagaucgaccuguggucguacaacgcggagcuccuggucgcccuggagaaccagcacaccaucgaccucaccgacgccgagaugaacaagcuguucgagaagacgcgcaagcagcugcgcgagaacgccgaggacaugggcaacgggugcuucaagaucuaccacaagugcgacaacgccugcaucggcuccauccggaacggcaccuacgaccacgacguguaccgcgacgaggcgcucaacaaccgguuccagaucaagggggucgagcucaagagcggcuacaaggacuggauccuguggaucuccuucgccaucagcugcuuccugcugugcguggugcugcucggguucaucaugugggccugccagaagggcaacauccgcugcaacaucugcaucuga

SEQ ID NO: 8805 - RNA, 1701 nt, Artificial Sequence
  derived and/or modified CDS sequence (AUadapt) from InfluenzaA__AFG99171__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgucgcugcggucccucguggccagcuccggcacgcuggaguucaccaacgagucguucaacuggaccggggugacccaguccggcgggagcuacgccugcaagcgcggcuccgacaacagcuucuucucccggcugaacuggcucuacgagucggaguccaaguaccccguccugaacgugacgaugcccaacaacgggaacuucgacaagcuguacaucuggggcgugcaccaccccagcaccgacaaggagcagaccaaccucuacguccgcgccucgggccgggugaccguguccacgaagcgcaaccagcagaccgucaucccgaacaucgggagccggcccugggugcgcggccuguccucgcggaucuccaucuacuggaccaucgugaagcccggggacauccugcucaucaacagcaacggcaaccugaucgcgccccgcggcuacuucaagauccggaacgggaaguccagcaucaugcgcuccgacgccccgaucgggaccugcucguccgagugcaucacgcccaacggcagcauccccaacgacaagcccuuccagaacgucaacaagaucaccuacggcgccugcccgaaguacgugaagcagaacacccugaagcucgccaccgggaugcggaacgugcccgagaagcagacgcgcggcaucuucggcgccaucgcgggguucaucgagaacggcugggaggggauggucgacggcugguacggguuccggcaccgcaacuccgagggcaccggccaggccgccgaccucaagucgacccaggccgccaucgaccagaucaacgggaagcugaaccgggugaucgagaagaccaacgagaaguuccaccagaucgagaaggaguucuccgagguggagggccgcauccaggaccucgagaaguacgucgaggacacgaagaucgaccuguggagcuacaacgcggagcugcucguggcccuggagaaccagcacaccaucgaccugaccgacuccgagaugaacaagcuguucgagaagacccggcgccagcugcgcgagaacgccgaggacauggggaacggcugcuucaagaucuaccacaagugcgacaacgccugcaucgggucgauccggaacggcacguacgaccacgacgucuaccgcgacgaggcccugaacaaccgguuccagaucaagggcguggagcucaaguccggguacaaggacuggauccuguggaucagcuucgcgaucagcugcuuccugcucugcgugguccugcugggcuucaucaugugggccugccagaaggggaacauccgcugcaacaucugcaucuga

SEQ ID NO: 8806 - RNA, 1701 nt, Artificial Sequence
  derived and/or modified CDS sequence (AUadapt) from InfluenzaA__AFG99182__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgucgcugcggucccucgucgccagcuccggcacgcuggaguucaucaacgagggguucaacuggaccggcgugacccagagcgggggcuccuacgccugcaagcgcgggucggugaacuccuucuucagccggcugaacuggcucuacgaguccgaguacaaguaccccgcccugaacgucaccaugcccaacaacggcaaguucgacaagcuguacaucuggggcgugcaccaccccagcacggacaaggagcagaccaaccucuacgugcgcgcguccgggcgggucaccgugucgaccaagcgcagccagcagacggugaucccgaacaucggcucccggcccuggguccgcgggcugucgucccggaucagcaucuacuggaccaucgugaagcccggcgacauccugcucaucaacuccaccggcaaccugaucgcgccccgcggguacuucaagauccggaccggcaagagcuccaucaugcgcucggacgccccgaucgggacgugcuccagcgagugcaucacccccaacggcuccauccccaacgacaagcccuuccagaacgugaacaagaucaccuacggggccugcccgcgguacgucaagcagaacacccugaagcucgccacgggcaugcgcaacgugcccgagaagcagacccggggcaucuucggggccaucgccggcuucaucgagaacgggugggagggcaugguggacgggugguacggcuuccgccaccagaacagcgagggcaccgggcaggccgccgaccugaaguccacccaggccgcgaucgaccagaucaacggcaagcugaaccggcucaucgagaagacgaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacaccaucgaccucaccgacagcgagaugaacaagcuguucgagaagacgcggaagcagcugcgcgagaacgccgaggacaugggcaacgggugcuucaagaucuaccacaagugcgacaacgccugcaucggcuccauccgcaacggcaccuacgaccacgacgucuaccgggacgaggcgcucaacaaccgcuuccagaucaaggggguggagcugaaguccggcuacaaggacuggauccuguggaucuccuucgccaucagcugcuuccuccugugcgucgugcugcucggguucaucaugugggccugccagaagggcaacauccggugcaacaucugcaucuga

SEQ ID NO: 8807 - RNA, 1701 nt, Artificial Sequence
  derived and/or modified CDS sequence (AUadapt) from InfluenzaA__AFG99193__HA
augaagaccaucaucgcccugucguacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucucgaacugcuaccccuacgacgugccggacuacgcgucccugcggagccucgucgccuccucgggcacgcuggaguucaucaacgagggguucaacuggaccggcgugacccaguccgggggcagcuacgccugcaagcgcggguccgugaacucguucuucucccggcugaacuggcucuacgagagcgaguccaaguaccccgcccugaacgucaccaugcccaacaacggcaaguucgagaagcuguacaucuggggcgugcaccaccccucgacggacaaggagcagaccaaccucuacgugcgcgcgagcgggcgggucaccguguccaccaagcgcucgcagcagacggugaucccgaacaucggcccccggcccuggguccgcgggcuguccagccggaucuccaucuacuggaccaucgugaagcccggcgacauccugcucaucaacucgaccggcaaccugaucgccccgcgcggguacuucaagauccggaccggcaaguccagcaucaugcgcuccgacgcccccaucgggacgugcucguccgagugcaucacccccaacggcagcauccccaacgacaagccguuccagaacgugaacaagaucaccuacggggccugcccccgguacgucaagcagaacacccugaagcucgccacgggcaugcgcaacgugcccgagaagcagacccggggcaucuucggggcgaucgccggcuucaucgagaacgggugggagggcaugguggacgggugguacggcuuccgccaccagaacuccgagggcaccgggcaggccgccgaccucaagucgacccaggccgcgaucgaccagaucaacggcaagcugaaccggcucaucgagaagacgaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgacaugaccgacuccgagaugaacaagcuguucgagaagacgcggaagcagcugcgcgagaacgccgaggacaugggcaacgggugcuucaagaucuaccacaagugcgacaacgccugcaucggcucgauccgcaacggcaccuacgaccacgacgucuaccgggacgaggcgcugaacaaccgcuuccagaucaaggggguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 8808 - RNA, 1701 nt, Artificial Sequence
  derived and/or modified CDS sequence (AUadapt) from InfluenzaA__AFG99204__HA
augaagaccaucaucgcccugucguacaucuucugccucggcuucgcccagaagcugcccgggaacgacaacuccaccgcgacgcugugccucggccaccacgccgugccgaacgggacccuggucaagaccaucaccaacgaccagaucgaggugacgaacgccaccgagcuggugcagagcuccucgaccggccgcaucugcgacagcccccaccggauccucgacgggaagaacugcacccugaucgacgcccugcucggcgacccccacugcgacggcuuccagaacgagaagugggaccuguucgucgagcgcucgaaggccuucuccaacugcuaccccuacgacgugccggacuacgcgagccugcggucccucguggccucguccgggacgcuggaguucaucaacgagggcuucaacuggaccggggucacccagagcggcggguccuacgccugcaagcgcggcagcgugaacuccuucuucucgcggcugaacuggcucuacaaguccgagagcaaguaccccgcccugaacgugaccaugcccaacaacggcaaguucgacaagcuguacaucuggggcguccaccaccccuccacggacaaggagcagaccaaccucuacgugcgcgcgucggggcgggugaccgucagcaccaagcgcucccagcagacggugaucccgaacaucgggucgcggcccugggugcgcggccuguccagccggaucuccaucuacuggaccaucgucaagcccggcgacauccugcucaucaacagcaccgggaaccugaucgcgccccgcggcuacuucaagauccggaccgggaaguccucgaucauccgcuccgacgccccgaucggcacgugcagcuccgagugcaucacccccaacgggucgauccccaacgacaagcccuuccagaacgugaacaagaucaccuacggcgccugcccgcgguacgugaagcagaacacccugaagcucgccacgggcaugcgcaacguccccgagaagcagacccgggggaucuucggcgccaucgccggguucaucgagaacggcugggaggggaugguggacggcugguacggcuuccgccaccagaacuccgaggggaccggccaggccgccgaccugaaguccacccaggccgcgaucgaccagaucaacgggaagcugaaccggcucaucgagaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgcggaagcagcugcgcgagaacgccgaggacauggggaacggcugcuucaagaucuaccacaagugcgacaacgccugcaucggcucgauccgcaacgggaccuacgaccacgacguguaccgggacgaggcgcucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 8809 - RNA, 1701 nt, Artificial Sequence
  derived and/or modified CDS sequence (AUadapt) from InfluenzaA__AFG99215__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucaucgagcgcucgaaggccuucuccaacugcuaccccuacgacgugccggacuacgcgagccugcggucccucguggccagcuccggcacgcuggaguucaucaacgagggguucaacuggaccggcgucacccagucggggggcuccuacgccugcaagcgcgggagcgugaacuccuucuucucgcggcugaacuggcucuacgaguccgaguacaaguaccccgcccugaacgugaccaugcccaacaacggcaaguucgacaagcuguacaucuggggcguccaccaccccagcacggagaaggagcagaccaaccucuacgugcgcgcguccgggcgggugaccgucagcaccaagcgcucgcagcagacggugaccccgaacaucggcucccggcccugggugcgcgggcugagcucccggaucucgaucuacuggaccaucgucaagcccggcgacauccugcucaucaacuccaccggcaaccugaucgcgccccgcggguacuucaagauccggacgggcaagagcuccaucaugcgcagcgacgccccgaucgggaccugcuccucggagugcaucacccccaacggcuccauccccaacgacaagcccuuccagaacgugaacaagaucaccuacggggccugcccgcgguacgugaagcagaacacgcugaagcucgccaccggcaugcgcaacguccccgagaagcagacccggggcaucuucggggccaucgccggcuucaucgagaacgggugggagggcaugguggacgggugguacggcuuccgccaccagaacagcgagggcaccgggcaggccgccgaccugaaguccacgcaggccgcgaucgaccagaucaacggcaagcugaaccggcucaucgagaagaccaacgagaaguuccaccagaucgagaaggaguucucggagguggaggggcgcauccaggaccuggagaaguacgucgaggacaccaagaucgaccugugguccuacaacgccgagcuccugguggcccuggagaaccagcacaccaucgaccucacggacagcgagaugaacaagcuguucgagaagacccggaagcagcugcgcgagaacgccgaggacaugggcaacgggugcuucaagaucuaccacaagugcgacaacgccugcaucggcuccauccgcaacggcaccuacgaccacgacguguaccgggacgaggcgcucaacaaccgcuuccagaucaagggggucgagcugaaguccggcuacaaggacuggauccuguggaucuccuucgccaucagcugcuuccuccugugcgugguccugcucggguucaucaugugggccugccagaagggcaacauccggugcaacaucugcaucuga

SEQ ID NO: 8810 - RNA, 1701 nt, Artificial Sequence
  derived and/or modified CDS sequence (AUadapt) from InfluenzaA__AFG99226__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagagcgggggcuccuacgccugcaagcgcgggucggugaacuccuucuucagccggcugaacuggcucuacgaguccgaguacaaguaccccgcccugaacgucaccaugcccaacaacggcaaguucgacaagcuguacaucuggggcgugcaccaccccagcacggacaaggagcagaccaaccucuacgugcgcgcguccgggcgggucaccgugucgaccaagcgcagccagcagacggugaucccgaacaucggcucccggcccuggguccgcgggcugucgucccggaucagcaucuacuggaccaucgugaagcccggcgacauccuguccaucaacagcaccggcaaccucaucgcgccccgcggguacuucaagauccggaccggcaaguccucgaucaugcgcuccgacgccccgaucgggacgugcagcuccgagugcaucacccccaacggcucgauccccaacgacaagcccuuccagaacgugaacaagaucaccuacggggccugcccgcgguacgucaagcagaacacccugaagcuggccacgggcaugcgcaacgugcccgagaagcagacccggggcaucuucggggccaucgccggcuucaucgagaacgggugggagggcaugguggacgggugguacggcuuccgccaccagaacuccgagggcaccgggcaggccgccgaccucaagagcacccaggccgcgaucgaccagaucaacggcaagcugaaccggcugaucgagaagacgaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugaccgacuccgagaugaacaagcuguucgagaagacgcggaagcagcuccgcgagaacgccgaggacaugggcaacgggugcuucaagaucuaccacaagugcgacaacgccugcaucggcucgauccgcaacggcaccuacgaccacgacgucuaccgggacgaggcgcugaacaaccgcuuccagaucaaggggguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 8811 - RNA, 1701 nt, Artificial Sequence
  derived and/or modified CDS sequence (AUadapt) from InfluenzaA__AFG99237__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgucgcugcggucccucgucgccagcuccggcacgcuggaguucaucaacgaggacuucaacuggaccggggugacccagagcggcggguccuacgccugcaagcgcgagucggugaacuccuucuucagccggcugaacuggcucuacgaguccgaguacaaguaccccgcccugaacgucaccaugcccaacaacggcaaguucgagaagcuguacaucuggggcgugcaccaccccagcacggacaaggagcagaccaaccucuacgugcgcgcguccgggcgggucaccgugucgaccaagcgcagccagcagacggugaucccgaacaucggcucccggcccuggguccgcgggcugucgucccggaucagcaucuacuggaccaucgugaagcccggcgacauccugcucaucaacuccaccgggaaccugaucgcgccccgcggcuacuucaagauccggaccggcaagagcuccaucaugcgcucggacgccccgaucgggacgugcuccagcgagugcaucacccccaacggcuccauccccaacgacaagcccuuccagaacgugaacaagaucaccuacggggccugcccgcgguacguccgccagaacacccugaagcucgccacgggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccugaaguccacccaggccgcgaucgaccagaucaacggcaagcugaaccgccucaucgagaagacgaacgagaaguuccaccagaucgagaaggaguucucggaggucgaggggcggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacaugggcaacgggugcuucaagaucuaccacaagugcgacaacgccugcaucggcuccauccggaacgggaccuacgaccacgacgucuaccgcgacgaggcgcucaacaaccgguuccagaucaagggcguggagcugaaguccggcuacaaggacuggauccuguggaucuccuucgccaucagcugcuuccuccugugcgucgugcugcucggguucaucaugugggccugccagaagggcaacauccgcugcaacaucugcaucuga

SEQ ID NO: 8812 - RNA, 1701 nt, Artificial Sequence
  derived and/or modified CDS sequence (AUadapt) from InfluenzaA__AFG99248__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccagcuccggcacgcuggaguucaucaacgaggacuucaacuggaccggggugacccagucgggcgggucccacgccugcaagcgcggcagcgugaacuccuucuucucgcggcugaacuggcuccacgaguccgaguacaaguaccccgcccugaacgucaccaugcccaacaacgggaaguucgacaagcuguacaucuggggcgugcaccaccccaucacggaccgcgagcagaccaaccucuacgugcgggcgagcggccgcgucaccguguccaccaagcggucgcagcagacggugaucccgaacaucggguuccgccccuggguccggggccugagcucccgcaucagcaucuacuggaccaucgugaagcccggggacauccugcucaucaacuccaccggcaaccugaucgcgccccggggcuacuucaagauccgcaacggcaagucguccaucaugcggagcgacgccccgaucgggaccugcuccucggagugcaucacgcccaacggguccauccccaacgacaagcccuuccagaacgugaacaagaucaccuacggcgccugcccgcgcuacgucaagcagaacacccugaagcucgccaccgggaugcggaacgugcccgagaagcagacgcgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagaccaacgagaaguuccaccagaucgagaaggaguucucggaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgcgagaacgccgaggacauggggaacggcugcuucaagaucuaccacaagugcgacaacgccugcaucggguccauccggaacggcacguacgaccacgacgucuaccgcgacgaggcgcucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 8813 - RNA, 1701 nt, Artificial Sequence
  derived and/or modified CDS sequence (AUadapt) from InfluenzaA__AFG99259__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagguggaggucacgaacgccaccgagcuggugcagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgucccggacuacgcgagccugcggucccucguggccucguccggcacgcuggaguucaucaacgaggacuucaacuggaccggggugacccagagcggcggguccuacgccugcaagcgcggcucggucaacuccuucuucagccggcugaacuggcuccacaaguccgaguacaaguaccccgcccugaacgugaccaugcccaacaacgggaaguucgacaagcuguacaucuggggcgugcaccaccccagcacggaccgcgagcagaccaaccucuacguccgggcguccggccgcgugaccgugucgaccaagcggagccagcagacggucaucccgaacaucgggucccgccccugggugcggggccugucgucccgcaucagcaucuacuggaccaucgugaagcccggggacauccugcucaucaacuccaccggcaaccugaucgcgccccggggcuacuucaagauccgcaccgggaaguccuccaucaugcggucggacgccccgaucggcacgugcuccagcgagugcaucacccccaacggguccauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgccggguucaucgagaacggcugggaggggauggucgacggcugguacggguuccggcaccagaacucggagggcaccggccaggccgccgaccugaaguccacccaggccgcgaucgaccagaucaacgggaagcugaaccgccucaucgagaagacgaacgagaaguuccaccagaucgagaaggaguucagcgagguggagggccggauccaggaccuggagaaguacguggaggacaccaagaucgaccugugguccuacaacgccgagcuccuggucgcccuggagaaccagcacaccaucgaccucaccgacucggagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggcgucgagcucaagagcggguacaaggacuggauccuguggaucuccuucgccaucagcugcuuccugcugugcguggugcugcucggcuucaucaugugggccugccagaaggggaacauccgcugcaacaucugcaucuga

SEQ ID NO: 8814 - RNA, 1701 nt, Artificial Sequence
  derived and/or modified CDS sequence (AUadapt) from InfluenzaA__AFG99270__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacaaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugucgaccaagcggagccagcagaccgugaucccgaacaucgggucccgccccuggguccggggccugucgucccgcaucagcaucuacuggacgaucgugaagcccggggacauccugcucaucaacuccaccggcaaccugaucgcgccccggggcuacuucaagauccgcaccggcaagucguccaucaugcggagcgacgccccgaucgggaccugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccacaacagcgagggcaccggccaggccgccgaccugaaguccacccaggcggccaucgaccagaucaacgggaagcugaaccggcucaucgagaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 8815 - RNA, 1701 nt, Artificial Sequence
  derived and/or modified CDS sequence (AUadapt) from InfluenzaA__AFG99281__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuucuccaacugcuaccccuacgacgugccggacuacgcgagccugcggucccucgucgccagcuccggcacgcuggaguucaucaacgaggaguucaacuggaccggggugacccagucgggcggguccuacgccugcaagcgcggcagcgugaacuccuucuucucgcggcugaacuggcuccacaaguccgaguacaaguaccccgcccugaacgucaccaugcccaacaacgggcgcuucgacaagcuguacaucuggggcgugcaccaccccagcacggaccgggagcagaccaaccucuacgugcgcgcguccggccgggucaccgugucgaccaagcgcagccagcagacggugaucccgaacaucgggccccggcccuggguccgcggccuguccagccggaucuccaucuacuggaccaucgugaagcccggggacauccugcucaucaacucgaccggcaaccugaucgccccgcgcggcuacuucaagauccacaccgggaaguccagcaucaugcgguccgacgcccccaucggcacgugcucguccgagugcaucacccccaacgggagcauccccaacgacaagccguuccagaacgugaacaagaucaccuacggcgccugcccccgcuacgucaagcagaacacccugaagcucgccacggggaugcggaacgugcccgacaagcagacccgcggcaucuucggcgcgaucgccggguucaucgagaacggcugggaggggaugguggacggcugguacggguuccggcaccagaacuccgagggcaccggccaggccgccgaccugaaguccacccaggccgcgaucgaccagaucaacgggaagcugaaccgccucaucgagaagacgaacgagaaguuccaccagaucgagaaggaguucuccgaggucgagggccggauccaggaccuggagaaguacguggaggacaccaagaucgaccuguggucguacaacgccgagcuccugguggcccuggagaaccagcacaccaucgaccucaccgacuccgagaugaacaagcuguucgagaagacgcgcaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaagggcguggagcugaaguccggguacaaggacuggauccuguggaucagcuucgccaucuccugcuuccuccugugcgucgugcugcucggcuucaucaugugggccugccagaaggggaacauccgcugcaacaucugcaucuga

SEQ ID NO: 8816 - RNA, 1701 nt, Artificial Sequence
  derived and/or modified CDS sequence (AUadapt) from InfluenzaA__AFG99292__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagguggaggucacgaacgccaccgagcuggugcagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgucccggacuacgcgagccugcggucccucguggccucguccggcacgcuggaguucaucaacgaggacuucaacuggaccggggugacccagagcggcggguccuacgccugcaagcgcggcucggucaacuccuucuucagccggcugaacuggcuccacgaguccgaguacaaguaccccgcccugaacgugaccaugcccaacaacgggaaguucgacaagcuguacaucuggggcgugcaccaccccagcacggaccgcgagcagaccaaccucuacguccgggcguccggccgcgugaccgugucgaccaagcggagccagcagacggucaucccgaacaucgggucccgccccugggugcggggccugucgucccgcaucagcaucuacuggaccaucgugaagcccggggacauccugcucaucaacuccaccggcaaccugaucgcgccccggggcuacuucaagauccgcaccgggaaguccuccaucaugcggucggacgccccgaucggcacgugcuccagcgagugcaucacccccaacggguccauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgccggguucaucgagaacggcugggaggggauggucgacggcugguacggguuccggcaccagaacucggagggcaccggccaggccgccgaccugaaguccacccaggccgcgaucgaccagaucaacgggaagcugaaccgccucaucgagaagacgaacgagaaguuccaccagaucgagaaggaguucagcgagguggagggccggauccaggaccuggagaaguacguggaggacaccaagaucgaccugugguccuacaacgccgagcuccuggucgcccuggagaaccagcacaccaucgaccucaccgacucggagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggcgucgagcucaagagcggguacaaggacuggauccuguggaucuccuucgccaucagcugcuuccugcugugcguggugcugcucggcuucaucaugugggccugccagaaggggaacauccgcugcaacaucugcaucuga

SEQ ID NO: 8817 - RNA, 1701 nt, Artificial Sequence
  derived and/or modified CDS sequence (AUadapt) from InfluenzaA__AFG99303__HA
augaagaccaucaucgcccugucguacaucuucugccucguggucgcccagaagcugcccggcaacgacaacuccaccgcgacgcugugccucgggcaccacgccgugccgaacggcacccuggugaagaccaucaccaacgaccagaucgaggucacgaacgccaccgagcuggugcagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgucccggacuacgcgagccugcggucccucguggccucguccggcacgcuggaguucaucaacgaggacuucaacuggaccgggguggcccagagcggcggguccuacgccugcaagcgcggcucggucaacuccuucuucagccggcugaacuggcuccacgaguccgaguacaaguaccccgcgcugaacgugaccaugcccaacaacgggaaguucgacaagcuguacaucuggggcgugcaccaccccucgaccgaccgcgagcagacgaaccucuacguccgggccuccggccgcgugaccgugagcaccaagcggucgcagcagaccgucaucccgaacaucgggucccgccccugggugcggggccugagcucccgcaucucgaucuacuggacgaucgugaagcccggggacauccugcucaucaacuccaccggcaaccugaucgcgccccggggcuacuucaagauccgcaccggcaagagcuccaucaugcggucggacgccccgaucgggaccugcuccagcgagugcaucacgcccaacggguccaucucgaacgacaagcccuuccagaacgucaaccgcaucaccuacggcgccugcccccgguacgugaagcagaacacccugaagcucgccaccgggaugcgcaacgugccggagaagcagacgcggggcaucuucggcgccaucgccggguucaucgagaacggcugggaggggauggucgacggcugguacggguuccgccaccagaacuccgagggcaccggccaggccgccgaccugaaguccacccaggcggccaucgaccagaucaacgggaagcugaaccggcucaucgagaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagaagacccgcaagcagcugcgggagaacgccgaggacauggggaacggcugcuucaagaucuaccacaagugcgacaacgcgugcaucgggucgauccgcaacggcacguacgaccacgacguguaccgggacgaggcccucaacaaccgcuuccagaucaagggcgucgagcugaaguccggguacaaggacuggauccuguggaucagcuucgccaucagcugcuuccuccugugcguggugcugcucggcuucaucaugugggccugccagaaggggaacauccggugcaacaucugcaucuga

SEQ ID NO: 8818 - RNA, 1701 nt, Artificial Sequence
  derived and/or modified CDS sequence (AUadapt) from InfluenzaA__AFG99314__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacucguuccagaacgagaagugggaccuguucguggagcgcuccaaggccuacagcaacugcuaccccuacgacgugccggacuacgcgucccugcggucgcucgucgccuccagcggcacgcuggaguucaucaacgaggacuucaacuggaccggcgugacccaguccgggggcagcuacgccugcaagcgcggguccgugaacucguucuucucccggcugaacuggcuccacgagagcgaguacaaguaccccgcccugaacgucaccaugcccaacaacggcaaguucgacaagcuguacaucugggggauccaccaccccuccacggaccgcgagcagaccaaccucuacgugcgggcgucgggccgcgugaccgucagcaccaagcggucccagcagacggugaucccgaacaucggcucgcgccccugggugcgggggcuguccagccgcaucuccaucuacuggaccaucgucaagcccggcgacauccugcucaucaacagcaccgggaaccugaucgcgccccggggcuacuucaagcugcgcaccggcaaguccucgaucaugcgguccgacgccccgaucgggacgugcagcuccgagugcaucacccccaacggcucgauccccaacgacaagcccuuccagaacgugaacaagaucaccuacggggccugcccgcgcuacgugaagcagaacacccucaagcuggccacgggcaugcggaacguccccgagaagcagacccgcgggaucuucggcgccaucgccggcuucaucgagaacgggugggagggcaugguggacgggugguacggcuuccggcaccagaacuccgaggggaccggccaggccgccgaccugaaguccacccaggccgcgaucgaccagaucaacggcaagcucaaccgccugaucgagaagacgaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgcgcaagcagcuccgcgagaacgccgaggacaugggcaacgggugcuucaagaucuaccacaagugcgacaacgccugcaucggcucgauccggaacgggaccuacgaccacgacguguaccgcgacgaggcgcugaacaaccgguuccagaucaagggcgucgagcugaaguccggcuacaaggacuggauccucuggaucagcuucgccaucagcugcuuccugcugugcgugguccuccugggguucaucaugugggccugccagaagggcaacauccgcugcaacaucugcaucuga

SEQ ID NO: 8819 - RNA, 1701 nt, Artificial Sequence
  derived and/or modified CDS sequence (AUadapt) from InfluenzaA__AFG99336__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacaaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugucgaccaagcggagccagcagaccgugaucccgaacaucgggucccgccccuggguccggggccugucgucccgcaucagcaucuacuggacgaucgugaagcccggggacauccugcucaucaacuccaccggcaaccugaucgcgccccggggcuacuucaagauccgcaccggcaagucguccaucaugcggagcgacgccccgaucgggaccugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 8820 - RNA, 1701 nt, Artificial Sequence
  derived and/or modified CDS sequence (AUadapt) from InfluenzaA__AFG99347__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacaagcccgaguacaaguaccccgcgcugaacgucaccaugcccaacaacgggaaguucgacaagcuguacaucuggggcgugcaccacccguccaccgaccgcgagcagacgaaccucuacgugcgggccucgggccgcgucaccguguccaccaagcggagccagcagaccgugauccccaacaucgggucgcgccccuggguccggggccuguccagccgcaucuccaucuacuggacgaucgugaagcccggggacauccugcucaucaacucgaccggcaaccugaucgccccgcggggcuacuucaagauccgcaccgggaaguccagcaucaugcgguccgacgcccccaucgggaccugcucguccgagugcaucacgcccaacggcagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggcgccaucgccggguucaucgagaacggcugggaggggaugguggacggcugguacggguuccgccaccagaacuccgagggcaccggccaggccgccgaccugaaguccacccaggcggccaucgaccagaucaacgggaagcugaaccggcucaucgacaagaccaacgagaaguuccaccagaucgagaaggaguucuccgaggucgagggccgcauccaggaccuggagaaguacguggaggacacgaagaucgaccuguggucguacaacgccgagcuccugguggcccuggagaaccagcacaccaucgaccucaccgacuccgagaugaacaagcuguucgagaagacccgcaagcagcugcgggagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagaaggggaacauccggugcaacaucugcaucuga

SEQ ID NO: 8821 - RNA, 1701 nt, Artificial Sequence
  derived and/or modified CDS sequence (AUadapt) from InfluenzaA__AFG99358__HA
augaagaccaucaucgcccugucgcacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcgggagcuacgccugcaagcgcggcuccgugaacucguucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugucgaccaagcgcagccagcagaccgugacgccgaacaucgggucccggcccuggguccgcggccucucgucccggaucagcaucuacuggaccaucgugaagcccggggacauccugcugaucaacuccaucggcaaccucaucgcgccccgcggcuacuucaagauccggaacgggaaguccuccaucaugcgcucggacgugccgaucggcaacugcuccagcgagugcaucacccccaacggguccauccccaacgacaagcccuuccagaacgucaaccggaucaccuacggcgccugcccgcgcuacgugaagcagaacacgcugaagcuggccaccgggaugcggaacgugcccgagaagcagacccgcggcaucuucggcgccaucgccggguucaucgagaacggcugggaggggauggucgacggcugguacggguuccggcaccagaacucggagggcaccggccaggccgccgaccucaaguccacgcaggccgcgaucgaccagaucaacgggaagcugaaccgccugaucgagaagaccaacgagaaguuccaccagaucgagaaggaguucagcgagguggagggccggauccaggaccucgagaaguacguggaggacaccaagaucgaccugugguccuacaacgccgagcugcucgucgcccuggagaaccagcacaccaucgaccugacggacucggagaugaacaagcuguucgagaagacccgcaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaagggcgucgagcucaagagcggguacaaggacuggauccuguggaucuccuucgccaucagcugcuuccugcucugcguggugcugcugggcuucaucaugugggccugccagaaggggaacauccgcugcaacaucugcaucuga

SEQ ID NO: 8822 - RNA, 1701 nt, Artificial Sequence
  derived and/or modified CDS sequence (AUadapt) from InfluenzaA__AFG99369__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacugggccgggguggcccagagcggcggguccuacgcgugcaagcgcggcucggugaacuccuucuucagccggcugaacuggcuccacgaguccgaguacaaguaccccgcccugaacgucaccaugcccaacaacgggaaguucgacaagcuguacaucuggggcgugcaccaccccucgaccgaccgcgagcagaccaaccucuacgugcgggccuccggccgcgucacggugagcaccaagcggucgcagcagaccgugaucccgaacaucgggucccgccccuggguccggggccugagcucccgcaucucgaucuacuggaccaucgugaagcccggggacauccugcucaucaacuccacgggcaaccugaucgcgccccggggcuacuucaagauccgcaccggcaagagcuccaucaugcggucggacgccccgaucgggaccugcuccagcgagugcaucacccccaacggguccauccccaacgacaagcccuuccagaacgugaaccgcaucacguacggcgccugcccgcgguacgucaagcagaacacccugaagcucgccaccgggaugcgcaacgugcccgagaagcagacccggggcaucuucggcgccaucgccggguucaucgagaacggcugggaggggaugguggacggcugguacggguuccgccaccagaacucggagggcacgggccaggccgcggaccugaaguccacccaggccgccaucgaccagaucaacgggaagcugaaccggcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagacccgcaagcagcugcgggagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaagggcguggagcugaaguccggguacaaggacuggauccuguggaucuccuucgccacgagcugcuuccuccugugcgucgugcugcucggcuucaucaugugggccugccagaaggggaacauccggugcaacaucugcaucuga

SEQ ID NO: 8823 - RNA, 1701 nt, Artificial Sequence
  derived and/or modified CDS sequence (AUadapt) from InfluenzaA__AFG99380__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugucgaccaagcggagccagcagaccgugaucccgaacaucgggucccgccccuggguccggggccugucgucccgcaucagcaucuacuggacgaucgugaagcccggggacauccugcucaucaacuccaccggcaaccugaucgcgccccggggcuacuucaagauccgcaccggcaagucguccaucaugcggagcgacgccccgaucgggaccugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 8824 - RNA, 1701 nt, Artificial Sequence; identical to SEQ ID NO: 8823
  derived and/or modified CDS sequence (AUadapt) from InfluenzaA__AFG99391__HA

SEQ ID NO: 8825 - RNA, 1701 nt, Artificial Sequence
  derived and/or modified CDS sequence (AUadapt) from InfluenzaA__AFG99402__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccagcuccggcacgcuggaguucaucaacgaggacuucaacuggaccggggugacccagucgggcggguccuacgccugcaagcgcggcagcgugaacuccuucuucucgcggcugaacuggcuccacaaguccgaguacaaguaccccgcccugaacgucaccaugcccaacaacgggaaguucgacaagcuguacaucuggggcgugcaccaccccgugacggaccgcgagcagaccaaccucuacguccgggcgagcggccgcgugaccguguccaccaagcggucgcagcagacggucaucccgaacaucgggagccgccccugggugcggggccuguccagccgcaucuccaucuacuggaccaucgugaagcccggggacauccugcucaucaacucgaccggcaaccugaucgcgccccggggcuacuucaagauccgcaccgggaaguccagcaucaugcgguccgacgccccgaucggcacgugcucguccgagugcaucacccccaacgggagcauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgccggguucaucgagaacggcugggaggggauggucgacggcugguacggguuccggcaccagaacuccgagggcaccggccaggccgccgaccugaaguccacccaggccgcgaucgaccagaucaacgggaagcugaaccgccucaucgagaagacgaacgagaaguuccaccagaucgagaaggaguucuccgagguggagggccggauccaggaccuggagaaguacguggaggacaccaagaucgaccuguggucguacaacgccgagcuccuggucgcccuggagaaccagcacaccaucgaccucaccgacuccgagaugaacaagcuguucgagaagacgcgcaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaagggcgucgagcugaaguccggguacaaggacuggauccuguggaucagcuucgccaucuccugcuuccuccugugcguggugcugcucggcuucaucaugugggccugccagaaggggaacauccgcugcaacaucugcaucuga

SEQ ID NO: 8826 - RNA, 1701 nt, Artificial Sequence
  derived and/or modified CDS sequence (AUadapt) from InfluenzaA__AFG99413__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugucgaccaagcggagccagcagaccgugaucccgaacaucgggucccgccccuggguccggggccugucgucccgcaucagcaucuacuggacgaucgugaagcccggggacauccugcucaucaacuccaccggcaaccugaucgcgccccggggcuacuucaagauccgcaccggcaagucguccaucaugcggagcgacgccccgaucgggaccugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgccggcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 8827 - RNA, 1701 nt, Artificial Sequence
  derived and/or modified CDS sequence (AUadapt) from InfluenzaA__AFG99424__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacaaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugucgaccaagcggagccagcagaccgugaucccgaacaucgggucccgccccuggguccggggccugucgucccgcaucagcaucuacuggacgaucgugaagcccggggacauccugcucaucaacuccaccggcaaccugaucgcgccccggggcuacuucaagauccgcaccggcaagucguccaucaugcggagcgacgccccgaucgggaccugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgccggcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 8828 - RNA, 1701 nt, Artificial Sequence
  derived and/or modified CDS sequence (AUadapt) from InfluenzaA__AFG99435__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagaacucguccaccgggcgcaucugcgacagcccccaccggauccucgacggcaagaacugcacccugaucgacgcccugcucggggacccccacugcgacggccugcagaacaaggagugggaccuguucguggagcgcuccaaggccuacucgaacugcuaccccuacgacgugccggacuacgcgucccuccggagccuggucgccuccucgggcacgcuggaguucaccaaggaggacuucaacuggaccgggguggcccaguccggcgggagcuacgccugcaagcgcggcuccgugaacucguucuucucccggcucaacuggcugcacgagucggaguacaaguaccccgcgcugaacgucaccaugcccaacaacgggaaguucgacaagcucuacaucuggggcgugcaccaccccuccacggaccgcgagcagaccaaccuguacgugcgggccagcggccgcgucaccguguccaccaagcggucgcagcagacggugaucccgaacaucgggagccgccccuggguccggggccuguccucgcgcaucuccaucuacuggaccaucgugaagcccggggacauccuccugaucaacagcaccggcaaccugaucgcgccccggggcuacuucaagauccgcaccgggaaguccucgaucaugcgguccgacgccccgaucggcacgugcucguccgagugcaucacccccaacgggagcauccccaacgacaagcccuuccagaacgugaaccgcaucaccuacggcgccugcccgcgguacgucaagcagaacacccucaagcuggccacggggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagucgacccaggcggccaucgaccagaucaacgggaagcugaaccggcugaucgagaagacgaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaaggggaacauccggugcaacaucugcaucuga

SEQ ID NO: 8829 - RNA, 1701 nt, Artificial Sequence; identical to SEQ ID NO: 8828
  derived and/or modified CDS sequence (AUadapt) from InfluenzaA__AFG99446__HA

SEQ ID NO: 8830 - RNA, 1701 nt, Artificial Sequence
  derived and/or modified CDS sequence (AUadapt) from InfluenzaA__AFG99457__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaucaacgaggacuucaacuggaccgggguggcccagucgggcggguccuacgccugcaagcgcggcagcgugaacuccuucuucucgcggcucaacuggcugcacaaguccgaguacaaguaccccgcgcugaacgucaccaugcccaacaacgggaaguucgacaagcucuacaucuggggcgugcaccaccccagcaccgaccgcgaccagacgucccuguacgugcgggccucgggccgcgucaccgugagcaccaagcggucccagcagaccgugaucccgaacaucgggucgcgccccuggguccggggccaguccagccgcaucuccaucuacuggacgaucgugaagcccggggacauccugcucaucaacucgaccggcaaccugaucgcgccccggggcuacuucaagauccgcaacgggaaguccagcaucaugcgguccgacgccccgaucgggaccugcucguccgagugcaucacccccaacggcagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggcgccaucgccggguucaucgagaacggcugggaggggaugguggacggcugguacggguuccgccaccagaacuccgagggcacgggccaggccgccgaccugaaguccacccaggcggccaucgaccagaucaacgggaagcugaaccggcucaucgagaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagaagacccgcaagcagcugcgggagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaagggcguggagcugaaguccggguacaaggacuggauccuguggaucucguucgccaucagcugcuuccuccugugcgucgugcugcucggcuucaucaugugggccugccagaaggggaacauccggugcaacaucugcaucuga

SEQ ID NO: 8831 - RNA, 1701 nt, Artificial Sequence
  derived and/or modified CDS sequence (AUadapt) from InfluenzaA__AFG99468__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugucgaccaagcggagccagcagaccgugaucccgaacaucgggucccgccccuggguccggggccugucgucccgcaucagcaucuacuggacgaucgugaagcccggggacauccugcucaucaacuccaccggcaaccugaucgcgccccggggcuacuucaagauccgcaccggcaagucguccaucaugcggagcgacgccccgaucgggaccugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagauggacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 8832 - RNA, 1701 nt, Artificial Sequence
  derived and/or modified CDS sequence (AUadapt) from InfluenzaA__AFG99490__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucaucgagcgcucgaaggccuacuccaacugcuaccccuacgacgugccggacuacgcgagccuccggucccugguggccucguccggcacgcuggaguucaucaacgaggacuucaacuggaccggggucgcccagagcggcgaguccuacgccugcaagcgcgggucggugaaguccuucuucagccggcucaacuggcugcacgaguccgaguacaaguaccccgcgcugaacgugaccaugcccaacaacggcaaguucgacaagcucuacaucuggggcguccaccaccccucgaccgaccgcgagcagacgucccuguacgugcgggccagcgggcgcgugaccgucucgaccaagcggucccagcagaccgugaucccgaacaucggcagccgccccugggugcgggggcuguccucgcgcaucuccaucuacuggacgaucgucaagcccggcgacauccuccugaucaacagcaccgggaaccugaucgcgccccggggcuacuucaagauccgcaccggcaaguccucgaucaugcgguccgacgccccgaucgggaccugcagcuccgagugcaucacgcccaacggcucgauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagaccaacgagaaguuccaccagaucgagaaggaguucuccgagguggaggggcgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcgucgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 8833 - RNA, 1701 nt, Artificial Sequence
  derived and/or modified CDS sequence (AUadapt) from InfluenzaA__AFG99501__HA
augaagaccaucaucgcccugucguacaucuucugccucguggucgcccagaagcugcccggcaacgacaacuccaccgcgacgcugugccucgggcaccacgccgugccgaacggcacccuggugaagaccaucaccaacgaccagaucgaggucacgaacgccaccgagcuggugcagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgucccggacuacgcgagccugcggucccucguggccucguccggcacgcuggaguucaucaacgaggacuucaacuggaccgggguggcccagagcggcggguccuacacgugcaagcgcggcucggucaacuccuucuucagccggcugaacuggcuccacgaguccgaguacaaguaccccgcccugaacgugaccaugcccaacaacgggaaguucgacaagcuguacaucuggggcgugcaccaccccucgaccgaccgcgagcagaccaaccucuacguccgggcguccggccgcgugaccgugagcaccaagcggucgcagcagacggucaucccgaacaucgggucccgccccugggugcggggccugagcucccgcaucucgaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccucggagugcaucacccccaacggguccaucagcaacgacaagcccuuccagaacgucaaccgcaucaccuacggcgccugcccccgguacgugaagcagaacacccugaagcucgccacggggaugcgcaacgugccggagaagcagacccggggcaucuucggcgccaucgccggguucaucgagaacggcugggaggggauggucgacggcugguacggguuccgccaccagaacuccgagggcaccggccaggccgccgaccucaagucgacccaggccgcgaucgaccagaucaacgggaagcugaaccggcugaucgagaagacgaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgcgcaagcagcugcgggagaacgccgaggacauggggaacggcugcuucaagaucuaccacaagugcgacaacgccugcaucgggucgauccgcaacggcaccuacgaccacgacguguaccgggacgaggcgcucaacaaccgcuuccagaucaagggcgucgagcugaaguccggguacaaggacuggauccuguggaucagcuucgccaucagcugcuuccuccugugcguggugcugcucggcuucaucaugugggccugccagaaggggaacauccggugcaacaucugcaucuga

SEQ ID NO: 8834 - RNA, 1701 nt, Artificial Sequence
  derived and/or modified CDS sequence (AUadapt) from InfluenzaA__AFG99512__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagagcggcgacuccuacgccugcaagcgcgggucggugaaguccuucuucagccggcucaacuggcugcacgaguccgaguacaaguaccccgcgcugaacgucaccaugcccaacaacgacaaguucgacaagcucuacaucuggggcgugcaccaccccucgaccgaccgcgagcagacgucccuguacauccgggccagcgggcgcgugaccgucucgaccaagcggucccagcagaccgugaucccgaacaucggcagccgccccugggugcggggccuguccucgcgcaucuccaucuacuggacgaucgucaagcccggggacauccuccugaucaacagcaccggcaaccugaucgcgccccggggguacuucaagauccgcaccggcaaguccucgaucaugcgguccgacgccccgaucgggaccugcagcuccgagugcaucacgcccaacggcucgauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucgaccagaucaacggcaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgcgugcaucgggucgauccgcaacggcacguacgaccacgacguguaccgggacgaggcccugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 8835 - RNA, 1701 nt, Artificial Sequence
  derived and/or modified CDS sequence (AUadapt) from InfluenzaA__AFG99523__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacgagucccaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugucgaccaagcggagccagcagaccgugaucccgaacaucgggucccgccccuggguccggggccugucgucccgcaucagcaucuacuggacgaucgugaagcccggggacauccugcucaucaacuccaccggcaaccugaucgcgccccggggcuacuucaagauccgcaccggcaagucguccaucaugcggagcgacgccccgaucgggaccugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 8836 - RNA, 1701 nt, Artificial Sequence; identical to SEQ ID NO: 8732
  derived and/or modified CDS sequence (AUadapt) from InfluenzaA__AFG99534__HA

SEQ ID NO: 8837 - RNA, 1701 nt, Artificial Sequence; identical to SEQ ID NO: 8732
  derived and/or modified CDS sequence (AUadapt) from InfluenzaA__AFG99545__HA

SEQ ID NO: 8838 - RNA, 1701 nt, Artificial Sequence
  derived and/or modified CDS sequence (AUadapt) from InfluenzaA__AFG99556__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccagucgggcgaguccuacgccugcaagcgcgggucggugaaguccuucuucagccggcucaacuggcugcacgaguccgacuacaaguaccccgcgcugaacgucaccaugcccaacaacggcaaguucgacaagcucuacaucuggggcgugcaccaccccucgacggaccgcgagcagaccucccuguacgugcgggccagcgggcgcgucaccgugucgaccaagcggucccagcagacggugaucccgaacaucggcagccgccccuggguccgggggcuguccucgcgcaucuccaucuacuggaccaucgugaagcccggcgacauccuccugaucaacucgaccgggaaccugaucgcgccccggggcuacuucaagauccgcaccggcaaguccagcaucaugcgguccgacgccccgaucgggacgugcucguccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccggaaguccacccaggcggccaucgaccagaucaacggcaagcugaaccgccucaucgagaagacgaacgagaaguuccaccagaucgagaaggaguucuccgaggucgaggggcgcauccaggaccuggagaaguacguggaggacaccaagaucgaccuguggucguacaacgccgagcuccugguggcccuggagaaccagcacaccaucgaccucaccgacuccgagaugaacaagcuguucgagaagacgcggaagcagcugcgcgagaacgccgaggacaugggcaacgggugcuucaagaucuaccacaagugcgacaacgcgugcaucggcagcauccggaacgggaccuacgaccacgacgucuaccgcgacgaggcccucaacaaccgguuccagaucaagggcguggagcugaaguccggcuacaaggacuggauccuguggaucucguucgccaucagcugcuuccuccugugcgucgugcugcucggguucaucaugugggccugccagaagggcaacauccgcugcaacaucugcaucuga

SEQ ID NO: 8839 - RNA, 1701 nt, Artificial Sequence; identical to SEQ ID NO: 8732
  derived and/or modified CDS sequence (AUadapt) from InfluenzaA__AFG99567__HA

SEQ ID NO: 8840 - RNA, 1701 nt, Artificial Sequence; identical to SEQ ID NO: 8732
  derived and/or modified CDS sequence (AUadapt) from InfluenzaA__AFG99578__HA

SEQ ID NO: 8841 - RNA, 1701 nt, Artificial Sequence; identical to SEQ ID NO: 8732
  derived and/or modified CDS sequence (AUadapt) from InfluenzaA__AFG99589__HA

SEQ ID NO: 8842 - RNA, 1701 nt, Artificial Sequence
  derived and/or modified CDS sequence (AUadapt) from InfluenzaA__AFG99600__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccgggugcuggacggcaagaacugcacccugaucgacgcccuccugggggacccccacugcgacggcuuccagaacaaggagugggaccuguucguggagcgcucgaaggccuacuccaacugcuaccccuacgacgucccggacuacgcgagccuccggucccugguggccucguccggcacgcuggaguucaccaacgaggacuucaacuggaccgggguggcccagagcggcgaguccuacgccugcaagcgcgggucggucaaguccuucuucagccggcucaacuggcugcacgaguccgacuacaaguaccccgcgcugaacgugaccaugcccaacaacggcaaguucgacaagcucuacaucuggggcgugcaccaccccucgacggaccgcgagcagaccucccuguacguccgggccagcgggcgcgugaccgugucgaccaagcggucccagcagacggucaucccgaacaucggcagccgccccugggugcgggggcuguccucgcgcaucuccaucuacuggaccaucgugaagcccggcgacauccuccugaucaacagcaccgggaaccugaucgcgccccggggcuacuucaagauccgcaucggcaaguccucgaucaugcgguccgacgccccgaucgggaccugcagcuccgagugcaucacgcccaacggcucgauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacuccgaggggaccggccaggccgccgaccugaaguccacccaggcggccaucgaccagaucaacggcaagcucaaccggcugaucgagaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcgucgagcugaaguccggcuacaaggacuggauccucuggaucagcuucgccaucagcugcuuccugcugugcguggugcuccugggguucaucaugugggccugccagaagggcaacauccggugcaacaucugcaucuga

SEQ ID NO: 8843 - RNA, 1701 nt, Artificial Sequence; identical to SEQ ID NO: 8732
  derived and/or modified CDS sequence (AUadapt) from InfluenzaA__AFG99611__HA

SEQ ID NO: 8844 - RNA, 1701 nt, Artificial Sequence; identical to SEQ ID NO: 8732
  derived and/or modified CDS sequence (AUadapt) from InfluenzaA__AFG99622__HA

SEQ ID NO: 8845 - RNA, 1701 nt, Artificial Sequence; identical to SEQ ID NO: 8732
  derived and/or modified CDS sequence (AUadapt) from InfluenzaA__AFG99633__HA

SEQ ID NO: 8846 - RNA, 1701 nt, Artificial Sequence
  derived and/or modified CDS sequence (AUadapt) from InfluenzaA__AFG99644__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucguccaccgggcgcaucugcgacagcccccaccggauccuggacggcaagaacugcacccugaucgacgcccuccugggggacccccacugcgacgacuuccagaacaaggagugggaccuguucguggagcgcuccaaggccuacucgaacugcuaccccuacgacgugccggacuacgcgucccuccggagccuggucgccgccuccggcacgcuggaguucaucaacgaggacuucaacuggaccggcguggcccagucgggggaguccuacgcgugcaagcgcggcagcgugaaguccuucuucucgcggcucaacuggcugcacgaguccgaguacaaguaccccgcccugaacgucaccaugcccaacaacgggaaguucgacaagcucuacaucuggggcgugcaccaccccagcaccgaccgcgagcagacgucccuguacgugcgggccucggggcgcgucaccguguccaccaagcggagccagcagaccgugaucccgaacaucggcucgcgccccuggguccggggccuguccagccgcaucuccaucuacuggacgaucgugaagcccggggacauccuccugaucaacucgaccggcaaccugaucgcgccccggggguacuucaagauccgcaccggcaaguccagcaucaugcgguccgacgccccgaucgggaccugcucguccgagugcaucacgcccaacggcagcauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgcggaccucaagucgacccaggccgccaucgaccagaucaacggcaagcugaaccggcugaucgagaagaccaacgagaaguuccaccagaucgagaaggaguucuccgagaucgagggccgcauccagaaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgcggaggacauggggaacggcugcuucaagaucuaccacaagugcgacaacgccugcaucgggucgauccgcaacggcacguacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 8847 - RNA, 1701 nt, Artificial Sequence
  derived and/or modified CDS sequence (AUadapt) from InfluenzaA__AFG99655__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacucgccccaccggauccuggacggcaagaacugcacccugaucgacgcccuccugggggacccccacugcgacgacuuccagaacaaggagugggaccuguucguggagcgcuccaaggccuacagcaacugcuaccccuacgacgugccggacuacgcgucccuccggucgcuggucgccuccagcggcacgcuggaguucaucaacgaggacuucaacuggaccggcguggcccaguccggggagucguacgccugcaagcgcggcuccgucaagagcuucuucucccggcucaacuggcugcacgagucggaguacaaguaccccgcgcugaacgugaccaugcccaacaacgggaaguucgacaagcucuacaucuggggcgugcaccaccccuccaccgaccgcgagcagacgagccuguacgugcgggccuccgggcgcgucaccgugucgaccaagcggagccagcagaccgugaucccgaacaucggcucccgccccuggguccggggccugucgucccgcaucagcaucuacuggacgaucgugaagcccggggacauccuccugaucaacuccaccggcaaccugaucgcgccccggggguacuucaagauccgcaccggcaagucguccaucaugcggagcgacgccccgaucgggaccugcuccucggagugcaucacgcccaacggcuccauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucucggagaucgagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccagaucaagggggucgagcucaagucgggcuacaaggacuggauccuguggaucuccuucgccaucagcugcuuccugcugugcgugguccuccugggcuucaucaugugggccugccagaaggggaacauccggugcaacaucugcaucuga

SEQ ID NO: 8848 - RNA, 1701 nt, Artificial Sequence; identical to SEQ ID NO: 8847
  derived and/or modified CDS sequence (AUadapt) from InfluenzaA__AFG99666__HA

SEQ ID NO: 8849 - RNA, 1701 nt, Artificial Sequence; identical to SEQ ID NO: 2583
  derived and/or modified CDS sequence (AUadapt) from InfluenzaA__AFG99677__HA

SEQ ID NO: 8850 - RNA, 1701 nt, Artificial Sequence; identical to SEQ ID NO: 8732
  derived and/or modified CDS sequence (AUadapt) from InfluenzaA__AFG99688__HA

SEQ ID NO: 8851 - RNA, 1701 nt, Artificial Sequence
  derived and/or modified CDS sequence (AUadapt) from InfluenzaA__AFG99701__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaacgccuacuccaacugcuaccccuacgacgugccggacuacgcgucgcuccggucccuggucgccagcuccggcacgcuggaguucaccaacgaggacuucaacuggaccgggguggcccagucgggcgaguccuacgccugcaagcgcgggucggugaaguccuucuucagccggcucaacuggcugcacgaguccgacuacaaguaccccgcgcugaacgucaccaugcccaacaacggcaaguucgacaagcucuacaucuggggcgugcaccaccccucgacggaccgcgagcagaccucccuguacgugcgggccagcgggcgcgucaccgugucgaccaagcggucccagcagacggugaucccgaacaucggcagccgccccuggguccgggggcuguccucgcgcaucuccaucuacuggaccaucgugaagcccggcgacauccuccugaucaacucgaccgggaaccugaucgcgccccggggcuacuucaagauccgcaccggcaaguccagcaucaugcgguccgacgccccgaucgggacgugcucguccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggucguacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcgccgagcugaaguccggcuacaaggacuggauccucuggaucucguucgccaucagcugcuuccugcugugcgugguccuccugggguucaucaugugggccugccagaagggcaacauccggugcaacaucugcaucuga

SEQ ID NO: 8852 - RNA, 1701 nt, Artificial Sequence
  derived and/or modified CDS sequence (AUadapt) from InfluenzaA__AFG99712__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgaggugccggacuacgcgucgcuccggucccuggucgccagcuccggcacgcuggaguucaccaacgaggacuucaacuggaccgggguggcccagucgggcgaguccuacgccugcaagcgcgggagcgugaaguccuucuucucgcggcucaacuggcugcacgaguccgacuacaaguaccccgcgcugaacgucaccaugcccaacaacggcaaguucgacaagcucuacaucuggggcgugcaccaccccagcacggaccgcgagcagaccucccuguacgugcgggccucggggcgcgucaccgugagcaccaagcggucccagcagacggugaucccgaacaucggcucgcgccccuggguccgggggcuguccagccgcaucuccaucuacuggaccaucgugaagcccggcgacauccuccugaucaacucgaccgggaaccugaucgcgccccggggcuacuucaagauccgcaccggcaaguccagcaucaugcgguccgacgccccgaucgggacgugcucguccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggucguacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcugaaguccggcuacaaggacuggauccucuggaucucguucgccaucagcugcuuccugcugugcgucgugcuccugggguucaucaugugggccugccagaagggcaacauccggugcaacaucugcaucuga

SEQ ID NO: 8853 - RNA, 1701 nt, Artificial Sequence; identical to SEQ ID NO: 8732
  derived and/or modified CDS sequence (AUadapt) from InfluenzaA__AFG99723__HA

SEQ ID NO: 8854 - RNA, 1701 nt, Artificial Sequence; identical to SEQ ID NO: 8847
  derived and/or modified CDS sequence (AUadapt) from InfluenzaA__AFG99734__HA

SEQ ID NO: 8855 - RNA, 1701 nt, Artificial Sequence
  derived and/or modified CDS sequence (AUadapt) from InfluenzaA__AFG99745__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagagcggcgacuccuacgccugcaagcgcgggucggugaaguccuucuucagccggcucaacuggcugcacgaguccgaguacaaguaccccgcgcugaacgucaccaugcccaacaacgacaaguucgacaagcucuacaucuggggcgugcaccaccccucgaccgagcgcgagcagacgucccuguacauccgggccagcgggcgcgugaccgucucgaccaagcggucccagcagaccgugaucccgaacaucggcagcaagcccugggugcgcggccuguccucgcggaucuccaucuacuggacgaucgucaagcccggggacauccuccugaucaacagcaccggcaaccugaucgcgccccgcggguacuucaagauccggaccggcaaguccucgaucaugcgcuccgacgccccgaucgggaccugcagcuccgagugcaucacgcccaacggcucgauccccaacgacaagcccuuccagaacgugaaccggaucaccuacggcgccugcccgcgcuacgugaagcagaacacccucaagcuggccaccgggaugcggaacguccccgagaagcagacgcgcggcaucuucggggccaucgccggcuucaucgagaacggcugggaggggaugguggacggcugguacggguuccggcaccagaacuccgagggcaccgggcaggccgccgaccugaaguccacccaggcggccaucgaccagaucaacggcaagcucaaccgccugaucgagaagaccaacgagaaguuccaccagaucgagaaggaguucuccgagguggagggccggauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgcgagaacgccgaggacauggggaacggcugcuucaagaucuaccacaagugcgacaacgcgugcauggggucgauccggaacggcacguacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 8856 - RNA, 1701 nt, Artificial Sequence; identical to SEQ ID NO: 8732
  derived and/or modified CDS sequence (AUadapt) from InfluenzaA__AFG99756__HA

SEQ ID NO: 8857 - RNA, 1701 nt, Artificial Sequence
  derived and/or modified CDS sequence (AUadapt) from InfluenzaA__AFG99767__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacgacuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccggcguggcccagagcggggaguccuacgccugcaagcgcggcucggugaaguccuucuucagccggcucaacuggcugcacgaguccgaguacaaguaccccgcgcugaacgucaccaugcccaacaacgacaaguucgacaagcucuacaucuggggcgugcaccaccccucgaccgaccgcgagcagacgucccuguacauccgggccagcggccgcgugaccgucucgaccaagcggucccagcagaccgugaucccgaacaucgggagccgccccugggugcggggccuguccucgcgcaucuccaucuacuggacgaucgucaagcccggcgacauccuccugaucaacagcaccgggaaccugaucgcgccccggggcuacuucaagauccgcaccgggaaguccucgaucaugcgguccgacgccccgaucgggaccugcagcuccgagugcaucacgcccaacggcucgauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccugaaguccacccaggcggccaucgaccagaucaacgggaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 8858 - RNA, 1701 nt, Artificial Sequence
  derived and/or modified CDS sequence (AUadapt) from InfluenzaA__AFG99778__HA
augaagaccaucaucgcccugucguacauccucugccugguguucgcccagaagcugcccggcaacgacaacuccaccgcgacgcucugccuggggcaccacgccgucccgaacggcacccuggugaagacccucaccaacgaccagaucgaggugacgaacgccaccgagcugguccagucguccagcaccgggaagaucugcgacucgccccaccgcauccuggacggcaagaacugcacccucaucgacgcccugcugggggacccccacugcgacggccuccagaacaaggagugggaccuguucguggagcgguccaaggccuacuccaacugcuaccccuacgacgugccggacuacgcgucgcugcgcucccucgucgccagcuccggcacgcuggaguucaucaacgaggacuucaacuggaccgggguggcccaggacggcgggucguacgccugcaagcggggcuccgugaacucguucuucucccgccugaacuggcuccacaagagcgaguacaaguaccccgcgcugaacgucaccaugcccaacaacgggaagguggacaagcuguacaucuggggcgugcaccaccccuccaccgaccgggaccagacgucgcucuacguccgcgccuccggccgggugaccgugagcaccaagcgcucgcagcagaccgucaucccgaacaucgggucccggcccugggugcgcggccagucgucccggaucagcaucuacuggacgaucgugaagcccggggacauccugcugaucaacuccaccggcaaccucaucgcgccccgcggcuacuucaagauccggaacggcaagucguccaucaugcgcucggacgccccgaucgggaccugcuccagcgagugcaucacccccaacggguccauccccaacgacaagcccuuccagaacgucaaccggaucacguacggcgccugcccgcgcuacgugaagcagaacacccugaagcuggccaccgggaugcggaacgugcccgagaagcagacccgcggcaucuucggcgccaucgccggguucaucgagaacggcugggaggggauggucgacggcugguacggguuccggcaccagaacucggagggcacgggccaggccgccgaccucaaguccacccaggcggccaucgaccagaucaacgggaagcugaaccgccugaucgagaagaccaacgagaaguuccaccagaucgagaaggaguucucggagguggagggccggauccaggaccucgagaaguacguggaggacaccaagaucgaccugugguccuacaacgccgagcugcucgucgcccuggagaaccagcacacgaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggcgucgagcucaagucgggguacaaggacuggauccuguggaucuccuucgccaucagcugcuuccugcucugcguggugcugcugggcuucaucaugugggccugccagaaggggaacauccgcugcaacaucugcaucuga

SEQ ID NO: 8859 - RNA, 1701 nt, Artificial Sequence; identical to SEQ ID NO: 8732
  derived and/or modified CDS sequence (AUadapt) from InfluenzaA__AFG99789__HA

SEQ ID NO: 8860 - RNA, 1701 nt, Artificial Sequence; identical to SEQ ID NO: 8847
  derived and/or modified CDS sequence (AUadapt) from InfluenzaA__AFG99800__HA

SEQ ID NO: 8861 - RNA, 1701 nt, Artificial Sequence
  derived and/or modified CDS sequence (AUadapt) from InfluenzaA__AFG99811__HA
augaagaccaucaucgcccugucguacauccucugccugguguucucccagaagcugcccggcaacgacaacagcaccgccacgcucugccuggggcaccacgcggucccgaacggcacccuggugaagaccaucaccaacgaccagaucgaggugacgaacgccaccgagcucguccagaacuccucgaccgggcgcaucugcgacagcccccaccggauccuggacggcaagaacugcacccugaucgacgcccuccugggggacccccacugcgacgacuuccagaacaaggagugggaccuguucguggagcgcucgaaggccuacuccaacugcuaccccuacgacgugccggacuacgccagccuccggucccuggucgcgucguccggcacgcuggaguucaucaacgaggacuucaacuggaccggcguggcccagagcggggaguccuacgccugcaagcgcggcucggugaaguccuucuucagccggcucaacuggcugcacgaguccgaguacaaguaccccgcccugaacgucaccaugcccaacaacgggaaguucgacaagcucuacaucuggggcgugcaccaccccucgaccgaccgcgagcagacgucccuguacgugcgggcgagcgggcgcgucaccgugucgaccaagcggucccagcagaccgugaucccgaacaucggcagccgccccuggguccggggccuguccucgcgcaucuccaucuacuggacgaucgugaagcccggggacauccuccugaucaacagcaccggcaaccugaucgcgccccggggguacuucaagauccgcaccggcaaguccucgaucaugcgguccgacgccccgaucgggaccugcagcuccgagugcaucacgcccaacggcucgauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggccgcgaucgaccagaucaacggcaagcucaaccggcugaucgagaagaccaacgagaaguuccaccagaucgagaaggaguucuccgagaucgagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgccugcaucgggucgauccgcaacggcacguacgaccacgacguguaccgggacgaggcgcugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 8862 - RNA, 1701 nt, Artificial Sequence; identical to SEQ ID NO: 8732
  derived and/or modified CDS sequence (AUadapt) from InfluenzaA__AFG99822__HA

SEQ ID NO: 8863 - RNA, 1701 nt, Artificial Sequence; identical to SEQ ID NO: 8732
  derived and/or modified CDS sequence (AUadapt) from InfluenzaA__AFG99833__HA

SEQ ID NO: 8864 - RNA, 1701 nt, Artificial Sequence; identical to SEQ ID NO: 8732
  derived and/or modified CDS sequence (AUadapt) from InfluenzaA__AFG99844__HA

SEQ ID NO: 8865 - RNA, 1701 nt, Artificial Sequence
  derived and/or modified CDS sequence (AUadapt) from InfluenzaA__AFG99855__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccagucgggcgaguccuacgccugcaagcgcgggagcgugaaguccuucuucucgcggcucaacuggcugcacgaguccgacuacaaguaccccgcgcugaacgucaccaugcccaacaacggcaaguucgacaagcucuacaucuggggcgugcaccaccccagcacggaccgcgagcagaccucccuguacgugcgggccucggggcgcgucaccgugagcaccaagcggucccagcagacggugaucccgaacaucggcucgcgccccuggguccgggggcuguccagccgcaucuccaucuacuggaccaucgugaagcccggcgacauccuccugaucaacucgaccgggaaccugaucgcgccccggggcuacuucaagauccgcaccggcaaguccagcaucaugcgguccgacgccccgaucgggacgugcucguccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgggaagcagacccggggcaucuucggcgccaucgccggguucaucgagaacggcugggaggggaugguggacggcugguacggguuccgccaccagaacuccgagggcaccggccaggccgccgaccugaaguccacccaggcggccaucgaccagaucaacgggaagcucaaccggcugaucgagaagacgaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugaccgacuccgagaugaacaagcuguucgagaagacgcgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcugaaguccggguacaaggacuggauccucuggaucucguucgccaucagcugcuuccugcugugcgucgugcuccugggcuucaucaugugggccugccagaaggggaacauccggugcaacaucugcaucuga

SEQ ID NO: 8866 - RNA, 1701 nt, Artificial Sequence; identical to SEQ ID NO: 8732
  derived and/or modified CDS sequence (AUadapt) from InfluenzaA__AFG99866__HA

SEQ ID NO: 8867 - RNA, 1701 nt, Artificial Sequence; identical to SEQ ID NO: 8732
  derived and/or modified CDS sequence (AUadapt) from InfluenzaA__AFG99877__HA

SEQ ID NO: 8868 - RNA, 1701 nt, Artificial Sequence
  derived and/or modified CDS sequence (AUadapt) from InfluenzaA__AFG99888__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagagcggcgaguccuacgccugcaagcgcgggucggugaaguccuucuucagccggcucaacuggcugcacgaguccgaguacaaguaccccgcgcugaacgucaccaugcccaacaacgacaaguucgacaagcucuacaucuggggcgugcaccaccccucgaccgaccgcgagcagacgucccuguacauccgggccagcgggcgcgugaccgucucgaccaagcggucccagcagaccgugaucccgaacaucggcagccgccccugggugcggggccuguccucgcgcaucuccaucuacuggacgaucgucaagcccggggacauccuccugaucaacagcaccggcaaccugaucgcgccccggggguacuucaagauccgcaccggcaaguccucgaucaugcgguccgacgccccgaucgggaccugcaacagcgagugcaucacgcccaacggcuccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacucggagggcaccgggcaggccgccgaccugaaguccacccaggcggccaucgaccagaucaacggcaagcucaaccggcugaucgagaagaccaacgagaaguuccaccagaucgagaaggaguucagcgagguggagggccgcauccaggaccuggagaaguacgucgaggacacgaagaucgaccucugguccuacaacgccgagcugcugguggcccucgagaaccagcacaccaucgaccugaccgacucggagaugaacaagcuguucgagaagacccgcaagcagcuccgggagaacgccgaggacauggggaacggcugcuucaagaucuaccacaagugcgacaacgcgugcaucggguccauccgcaacggcacguacaaccacgacguguaccgggacgaggcccugaacaaccgcuuccagaucaagggggucgagcugaaguccggcuacaaggacuggauccucuggaucuccuucgccaucagcugcuuccugcugugcgugguccuccugggcuucaucaugugggccugccagaaggggaacauccggugcaacaucugcaucuga

SEQ ID NO: 8869 - RNA, 1701 nt, Artificial Sequence; identical to SEQ ID NO: 8732
  derived and/or modified CDS sequence (AUadapt) from InfluenzaA__AFG99899__HA

SEQ ID NO: 8870 - RNA, 1701 nt, Artificial Sequence; identical to SEQ ID NO: 8732
  derived and/or modified CDS sequence (AUadapt) from InfluenzaA__AFG99910__HA

SEQ ID NO: 8871 - RNA, 1701 nt, Artificial Sequence; identical to SEQ ID NO: 8732
  derived and/or modified CDS sequence (AUadapt) from InfluenzaA__AFG99921__HA

SEQ ID NO: 8872 - RNA, 1701 nt, Artificial Sequence
  derived and/or modified CDS sequence (AUadapt) from InfluenzaA__AFG99932__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagagcggcgaguccuacgccugcaagcgcgggucggugaaguccuucuucagccggcucaacuggcugcacgaguccgaguacaaguaccccgcgcugaacgucaccaugcccaacaacgacaaguucgacaagcucuacaucuggggcgugcaccaccccucgaccgaccgcgagcagacgucccuguacauccgggccagcgggcgcgugaccgucucgaccaagcggucccagcagaccgugaucccgaacaucggcagccgccccugggugcggggccuguccucgcgcaucuccaucuacuggacgaucgucaagcccggggacauccuccugaucaacagcaccggcaaccugaucgcgccccggggguacuucaagauccgcaccggcaaguccucgaucaugcgguccgacgccccgaucgggaccugcagcuccgagugcaucacgcccaacggcucgauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucgaccagaucaacggcaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgcgugcaucgggucgauccgcaacggcacguacgaccacgacguguaccgggacgaggcccugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 8873 - RNA, 1701 nt, Artificial Sequence; identical to SEQ ID NO: 8732
  derived and/or modified CDS sequence (AUadapt) from InfluenzaA__AFG99943__HA

SEQ ID NO: 8874 - RNA, 1701 nt, Artificial Sequence
  derived and/or modified CDS sequence (AUadapt) from InfluenzaA__AFG99954__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccagcuccggcacgcuggaguucaucaacgaggacuucaacuggaccgggguggcccagucgggcgacuccuacgccugcaagcgcgggagcgugaaguccuucuucucgcggcucaacuggcugcacgaguccgaguacaaguaccccgcgcugaacgucaccaugcccaacaacgacaaguucgacaagcucuacaucuggggcgugcaccaccccagcaccgagcgcgagcagacgucccuguacauccgggccagcgggcgcgugaccgucucgaccaagcggucccagcagaccgugaucccgaacaucggcuucaagcccugggugcgcggccugagcucccggaucucgaucuacuggacgaucgucaagcccggggacauccuccugaucaacuccaccggcaaccugaucgcgccccgcggguacuucaagauccggaccggcaagagcuccaucaugcgcagcgacgccccgaucgggaccugcuccucggagugcaucacgcccaacggcuccauccccaacgacaagcccuuccagaacgugaaccggaucaccuacggcgccugcccgcgcuacgugaagcagaacacccucaagcuggccaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucgaccagaucaacggcaagcucaaccgccugaucgagaagaccaacgagaaguuccaccagaucgagaaggaguucucggagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcacguacgaccacgacguguaccgcgacgaggcccugaacaaccgguuccagaucaagggggucgagcugaaguccggcuacaaggacuggauccucuggaucuccuucgccaucagcugcuuccugcugugcgugguccuccugggcuucaucaugugggccugccagaaggggaacauccgcugcaacaucugcaucuga

SEQ ID NO: 8875 - RNA, 1701 nt, Artificial Sequence
  derived and/or modified CDS sequence (AUadapt) from InfluenzaA__AFG99965__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccggauccuggacggcaagaacugcacccugaucgacgcccuccugggggacccccacugcgacggcuuccagaacaaggagugggaccuguucgucgagcgcagcaaggcguacuccaacugcuaccccuacgacgugccggacuacgccucgcuccggucccugguggccagcuccggcacgcuggaguucaccaacgaggacuucaacuggaccggggucgcccagucgggcgaguccuacgcgugcaagcgcgggucggugaaguccuucuucagccggcucaacuggcugcacgaguccgacuacaaguaccccgcccugaacgugaccaugcccaacaacggcaaguucgacaagcucuacaucuggggcguccaccaccccucgacggaccgcgagcagaccucccuguacgugcgggccagcgggcgcgugaccgucucgaccaagcggucccagcagacggugaucccgaacaucggcagccgccccugggugcgggggcuguccucgcgcaucuccaucuacuggaccaucgucaagcccggcgacauccuccugaucaacucgaccgggaaccugaucgcgccccggggcuacuucaagauccgcaccggcaaguccagcaucaugcgguccgacgccccgaucgggacgugcucguccgagugcaucacccccaacggcagcauccccaacgacaagcccuuccagaacgugaaccgcaucaccuacggggccugcccgcgguacgugaagcagaacacccucaagcuggccacgggcaugcgcaacguccccgagaagcagacccgggggaucuucggcgccaucgccggcuucaucgagaacgggugggagggcaugguggacgggugguacggcuuccgccaccagaacuccgaggggaccggccaggccgcggaccugaaguccacccaggccgccaucgaccagaucaacggcaagcucaaccggcugaucgagaagacgaacgagaaguuccaccagaucgagaaggaguucuccgagguggaggggcgcauccaggaccuggagaaguacgucgaggacaccaagaucgaccucuggucguacaacgccgagcugcugguggcccucgagaaccagcacaccaucgaccugaccgacuccgagaugaacaagcuguucgagaagacgcgcaagcagcuccgggagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggcuacaaggacuggauccucuggaucucguucgccaucagcugcuuccugcugugcgugguccuccugggguucaucaugugggccugccagaagggcaacauccggugcaacaucugcaucuga

SEQ ID NO: 8876 - RNA, 1701 nt, Artificial Sequence; identical to SEQ ID NO: 8732
  derived and/or modified CDS sequence (AUadapt) from InfluenzaA__AFG99976__HA

SEQ ID NO: 8877 - RNA, 1701 nt, Artificial Sequence
  derived and/or modified CDS sequence (AUadapt) from InfluenzaA__AFG99987__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagaacggcgacagcuacgccugcaagcgcggguccgugaaguccuucuucucccggcucaacuggcugcacgagucggaguacaaguaccccgcgcugaacgucaccaugcccaacaacgacaaguucgacaagcucuacaucuggggcgugcaccaccccuccaccgaccgcgagcagacgagccuguacauccgggccuccgggcgcgugaccgucucgaccaagcggagccagcagaccgugaucccgaacaucggcucccgccccugggugcggggccugucgucccgcaucagcaucuacuggacgaucgucaagcccggggacauccuccugaucaacuccaccggcaaccugaucgcgccccggggguacuucaagauccgcaccggcaagucguccaucaugcggagcgacgccccgaucgggaccugcuccucggagugcaucacgcccaacggcuccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucucggagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccagaucaagggggucgagcucaagucgggcuacaaggacuggauccuguggaucuccuucgccaucagcugcuuccugcugugcgugguccuccugggcuucaucaugugggccugccagaaggggaacauccggugcaacaucugcaucuga

SEQ ID NO: 8878 - RNA, 1701 nt, Artificial Sequence
  derived and/or modified CDS sequence (AUadapt) from InfluenzaA__AFG99998__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcgggagcuacgccugcaagcgcggcuccgugaacucguucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgucgcuguacgugcgcgccuccggccgggucaccgugagcaccaagcgcucgcagcagaccgugacgccgaacaucgggucccggcccuggguccgcggccucagcucccggaucucgaucuacuggaccaucgugaagcccggggacauccugcugaucaacuccaccggcaaccucaucgcgccccgcggcuacuucaagauccggaacgggaaguccuccaucaugcgcagcgacgccccgaucggcaacugcuccucggagugcaucacccccaacggguccauccccaacgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgccggguucaucgagaacggcugggaggggaugguggacggcugguacggguuccggcaccagaacagcgagggcacgggccaggccgccgaccucaaguccacccaggcggccaucgaccagaucaacgggaagcugaaccgccugaucgagaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 8879 - RNA, 1701 nt, Artificial Sequence; identical to SEQ ID NO: 8847
  derived and/or modified CDS sequence (AUadapt) from InfluenzaA__AFH00021__HA

SEQ ID NO: 8880 - RNA, 1701 nt, Artificial Sequence
  derived and/or modified CDS sequence (AUadapt) from InfluenzaA__AFH00032__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggaagaucugcgacagcccccaccgcauccuggacggcaagaacugcacccugaucgacgcccuccugggggacccccacugcgacgacuuccagaacaaggagugggaccuguucguggagcggucgaaggccuacuccaacugcuaccccuacgacgugccggacuacgcgagccuccgcucccuggucgccucguccggcacgcuggaguucaucaacgaggacuucaacuggaccggcguggcccagagcggggacuccuacgccugcaagcggggcucggugaaguccuucuucagccgccucaacuggcugcacgaguccgaguacaaguaccccgcgcugaacgucaccaugcccaacaacgacaaguucgacaagcucuacaucuggggcgugcaccaccccucgaccgaccgggagcagacgucccuguacauccgcgccagcggccgggugaccgucucgaccaagcgcucccagcagaccgugaucccgaacaucgggagccggcccugggugcgcggccuguccucgcggaucuccaucuacuggacgaucgucaagcccggcgacauccuccugaucaacagcaccgggaaccugaucgcgccccgcggcuacuucaagauccggaccgggaaguccucgaucaugcgcuccgacgccccgaucgggaccugcagcuccgagugcaucacgcccaacggcucgauccccaacgacaagcccuuccagaacgugaaccggaucaccuacggggccugcccgcgcuacgugaagcagaacacccucaagcuggccaccggcaugcggaacguccccgagaagcagacgcgcgggaucuucggcgccaucgccggguucaucgagaacggcugggagggcaugguggacgggugguacggcuuccggcaccagaacuccgaggggaccggccaggccgccgaccugaaguccacccaggcggccaucgaccagaucaacgggaagcucaacaagcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccggaagcagcuccgcgagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 8881 - RNA, 1701 nt, Artificial Sequence
  derived and/or modified CDS sequence (AUadapt) from InfluenzaA__AFH00043__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggaagaucugcgacagcccccaccgcauccuggacggcaagaacugcacccugaucgacgcccuccugggggacccccacugcgacgacuuccagaacaaggagugggaccuguucguggagcggucgaaggccuacuccaacugcuaccccuacgacgugccggacuacgcgagccuccgcucccuggucgccucguccggcacgcuggaguucaucaacgaggacuucaacuggaccggcguggcccagagcggggacuccuacgccugcaagcggggcucggugaaguccuucuucagccgccucaacuggcugcacgaguccgaguacaaguaccccgcgcugaacgucaccaugcccaacaacgacaaguucgacaagcucuacaucuggggcgugcaccaccccucgaccgaccgggagcagacgucccuguacauccgcgccagcgggcgggugaccgucucgaccaagcgcucccagcagaccgugaucccgaacaucgggagccggcccugggugcgcggccuguccucgcggaucuccaucuacuggacgaucgucaagcccggcgacauccuccugaucaacagcaccgggaaccugaucgcgccccgcggcuacuucaagauccggaccgggaaguccucgaucaugcgcuccgacgccaccaucggcacgugcagcuccgagugcaucaccccgaacggcucgauccccaacgacaagcccuuccagaacgugaaccggaucaccuacggggccugcccccgcuacgugaagcagaacacccucaagcuggccacgggcaugcggaacgucccggagaagcagacccgcgggaucuucggcgccaucgccggguucaucgagaacggcugggagggcaugguggacgggugguacggcuuccggcaccagaacuccgaggggaccggccaggccgccgaccugaaguccacccaggcggccaucgaccagaucaacgggaagcucaacaagcugaucgagaagacgaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgcggaagcagcuccgcgagaacgccgaggacaugggcaacgggugcuucaagaucuaccacaagugcgacaacgcgugcaucggcucgauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 8882 - RNA, 1701 nt, Artificial Sequence
  derived and/or modified CDS sequence (AUadapt) from InfluenzaA__AFH00054__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagaacggcgacagcuacgccugcaagcgcggguccgugaaguccuucuucucccggcucaacuggcugcacgagucggaguacaaguaccccgcgcugaacgucaccaugcccaacaacgacaaguucgacaagcucuacaucuggggcgugcaccaccccuccaccgaccgcgagcagacgagccuguacauccgggccuccgggcgcgugaccgucucgaccaagcggagccagcagaccgugaucccgaacaucggcucccgccccugggugcggggccugucgucccgcaucagcaucuacuggacgaucgucaagcccggggacauccuccugaucaacuccaccggcaaccugaucgcgccccggggguacuucaagauccgcaccggcaagucguccaucaugcggagcgacgccccgaucgggaccugcuccucggagugcaucacgcccaacggcuccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucucggagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccacaucaagggggucgagcucaagucgggcuacaaggacuggauccuguggaucuccuucgccaucagcugcuuccugcugugcgugguccuccugggcuucaucaugugggccugccagaaggggaacauccggugcaacaucugcaucuga

SEQ ID NO: 8883 - RNA, 1701 nt, Artificial Sequence
  derived and/or modified CDS sequence (AUadapt) from InfluenzaA__AFH00065__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaucaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccucgaccgacuccgaccagacgagccuguacgugcgcgccuccggccgggucaccgugucgaccaagcgcagccagcagaccgugaucccgaacaucgggucccggcccuggguccgcggccagcccucgcggaucuccaucuacuggacgaucgugaagcccggggacauccuccugaucaacagcaccggcaaccugaucgccccgcgcggcuacuucaagauccggaacgggaaguccucgaucaugcgcuccgacgcccccaucggcaacugcagcuccgagugcaucacccccaacgggucgauccccaacgacaagccguuccagaacgugaaccggaucaccuacggcgccugcccccgcuacgucaagcagaacacgcucaagcuggcgaccgggaugcggaacgugcccgagaagcagacccgcggcaucuucggcgccaucgccggguucaucgagaacggcugggaggggaugguggacggcugguacggguuccggcaccagaacuccgagggcaccggccaggccgccgaccugaaguccacgcaggcggccaucgaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaaggggaacauccggugcaacaucugcaucuga

SEQ ID NO: 8884 - RNA, 1701 nt, Artificial Sequence
  derived and/or modified CDS sequence (AUadapt) from InfluenzaA__AFH00076__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggaagaucugcgacagcccccaccgcauccuggacggcaagaacugcacccugaucgacgcccuccugggggacccccacugcgacgacuuccagaacaaggagugggaccuguucguggagcggucgaaggccuacuccaacugcuaccccuacgacgugccggacuacgcgagccuccgcucccuggucgccucguccggcacgcuggaguucaucaacgaggacuucaacuggaccggcguggcccagagcggggacuccuacgccugcaagcggggcucggugaaguccuucuucagccgccucaacuggcugcacgaguccgaguacaaguaccccgcgcugaacgucaccaugcccaacaacgacaaguucgacaagcucuacaucuggggcgugcaccaccccucgaccgaccgggagcagacgucccuguacauccgcgccagcggccgggugaccgucucgaccaagcgcucccagcagaccgugaucccgaacaucgggagccggcccugggugcgcggccuguccucgcggaucuccaucuacuggacgaucgucaagcccggcgacauccuccugaucaacagcaccgggaaccugaucgcgccccgcggcuacuucaagauccggaccgggaaguccucgaucaugcgcuccgacgccccgaucgggaccugcaacagcgagugcaucacgcccaacggcuccauccccaacgacaagcccuuccagaacgugaaccggaucaccuacggggccugcccgcgcuacgugaagcagaacacccucaagcuggccaccggcaugcggaacguccccgagaagcagacgcgcgggaucuucggcgccaucgccggguucaucgagaacggcugggagggcaugguggacgggugguacggcuuccggcaccagaacucggaggggaccggccaggccgccgaccugaaguccacccaggcggccaucgaccagaucaacgggaagcucaaccgccugaucgagaagaccaacgagaaguuccaccagaucgagaaggaguucagcgagguggagggccggauccaggaccuggagaaguacgucgaggacacgaagaucgaccucugguccuacaacgccgagcugcugguggcccucgagaaccagcacaccaucgaccugaccgacucggagaugaacaagcuguucgagaagacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcugaaguccggguacaaggacuggauccucuggaucuccuucgccaucagcugcuuccugcugugcgugguccuccugggcuucaucaugugggccugccagaagggcaacauccgcugcaacaucugcaucuga

SEQ ID NO: 8885 - RNA, 1701 nt, Artificial Sequence
  derived and/or modified CDS sequence (AUadapt) from InfluenzaA__AFH00087__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucggaggccuacuccagcugcuaccccuacgacgugccggacuacgcgucccuccggucgcuggucgccuccagcggcacgcuggaguucaucaacgaggacuucaacuggaccgggguggcccaggacggcaaguccuacgccugcaagcgcgggucggugaacuccuucuucagccggcucaacuggcugcacaagcuggaguacaaguaccccgcgcucaacgucaccaugcccaacaacggcaaguucgacaagcuguacaucuggggcgugcaccaccccuccaccgacucggaccagacgucccuguacgugcgcgccagcgggcgggucaccgugucgaccaagcgcucccagcagaccgugaucccgaacaucggcagccggcccuggguccgcgggcaguccucgcggaucggcaucuacuggacgaucgugaagcccggggacauccuccugaucaacuccaccggcaaccugaucgcgccccgcggcuacuucaagauccggaacgggaaguccuccaucaugcgcagcgacgccccgaucggcaacugcuccucggagugcaucacccccaacggguccauccccaacgacaagcccuuccagaacgugaacaagaucaccuacggcgccugcccgcgguacgucaagcagaacacgcucaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccugaaguccacgcaggcggccaucgaccagaucaacgggaagcucaaccggcugaucgagaagaccaacgagaaguuccaccagaucgagaaggaguucucggaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcugugcgucgugcuccugggcuucaucaugugggccugccagaaggggaacauccgcugcaacaucugcaucuga

SEQ ID NO: 8886 - RNA, 1701 nt, Artificial Sequence
  derived and/or modified CDS sequence (AUadapt) from InfluenzaA__AFH00098__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccucgaccgacuccgaccagacgagccuguacgugcgcgccuccggccgggucaccgugucgaccaagcgcagccagcagaccgugaucccgaacaucgggucccggcccuggguccgcggccuccccucgcggaucuccaucuacuggacgaucgugaagcccggggacauccugcugaucaacagcaccggcaaccucaucgccccgcgcggcuacuucaagauccggaacgggaaguccucgaucaugcgcuccgacgcccccaucggcaacugcagcuccgagugcaucacccccaacgggucgauccccaacgacaagccguuccagaacgugaaccggaucaccuacggcgccugcccccgcuacgucaagcagaacacgcugaagcuggcgaccgggaugcggaacgugcccgagaagcagacccgcggcaucuucggcgccaucgccggguucaucgagaacggcugggaggggaugguggacggcugguacggguuccggcaccagaacuccgagggcaccggccaggccgccgaccucaagagcacgcaggcggccaucgaccagaucaacgggaagcugaaccgccugaucgagaagaccaacgagaaguuccaccagaucgagaaggaguucuccgaggucgagggccggauccaggaccucgagaaguacguggaggacaccaagaucgaccuguggucguacaacgccgagcugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 8887 - RNA, 1701 nt, Artificial Sequence
  derived and/or modified CDS sequence (AUadapt) from InfluenzaA__AFH00109__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacacgugcaagcgcggguccgugaacucguucuucucccggcucaacuggcugcacaagcuggaguacaaguaccccgcccucaacgucaccaugcccaacaacggcaaguucgacaagcuguacaucuggggcgugcaccaccccagcaccgacuccgaccagaccagccuguacgugcgcgcguccgggcgggucaccgugucgaccaagcgcagccagcagacggugaucccgaacaucggcuuccggcccuggguccgcgggcucuccagccggaucuccaucuacuggaccaucgugaagcccggcgacauccugcugaucaacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucacguacggggccugcccgcgcuacgucaagcagaacacccugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggacgggccaggccgccgaccucaagagcacccaggccgcgaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacacgaucgaccugaccgacuccgagaugaacaagcuguucgagcgcacccgcaagcagcuccgggagaacgccgaggacauggggaacggcugcuucaagaucuaccacaagugcgacaacgccugcaucgggagcauccgcaacggcaccuacgaccacgacgucuaccgggacgaggcgcugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 8888 - RNA, 1701 nt, Artificial Sequence
  derived and/or modified CDS sequence (AUadapt) from InfluenzaA__AFH00120__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggcgggucaccgugagcaccaagcgcucgcagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccucgaucaugcgcuccgacgccccgaucgggaacugcagcuccgagugcaucacccccaacggcucgauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaccaugugggccugccagaaggggaacauccggugcaacaucugcaucuga

SEQ ID NO: 8889 - RNA, 1701 nt, Artificial Sequence; identical to SEQ ID NO: 8743
  derived and/or modified CDS sequence (AUadapt) from InfluenzaA__AFH00131__HA

SEQ ID NO: 8890 - RNA, 1701 nt, Artificial Sequence
  derived and/or modified CDS sequence (AUadapt) from InfluenzaA__AFH00153__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacauccgcgccuccgggcgggugaccgucagcaccaagcgcucgcagcagaccgugaucccgaacaucggcucccggcccugggugcgcgggcucagcucccggaucucgaucuacuggacgaucgucaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgugaagcagaacacgcugaagcuggccaccggcaugcggaacguccccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugaucgagaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcgugguccugcugggguucaucaugugggccugccagaagggcaacauccggugcaacaucugcaucuga

SEQ ID NO: 8891 - RNA, 1701 nt, Artificial Sequence
  derived and/or modified CDS sequence (AUadapt) from InfluenzaA__AFH00164__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugauggacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagaacggcgacagcuacgccugcaagcgcggguccgugaaguccuucuucucccggcucaacuggcugcacgagucggaguacaaguaccccgcgcugaacgucaccaugcccaacaacgacaaguucgacaagcucuacaucuggggcgugcaccaccccuccaccgaccgcgagcagacgagccuguacauccgggccuccgggcgcgugaccgucucgaccaagcggagccagcagaccgugaucccgaacaucggcucccgccccugggugcggggccugucgucccgcaucagcaucuacuggacgaucgucaagcccggggacauccuccugaucaacuccaccggcaaccugaucgcgccccggggguacuucaagauccgcaccggcaagucguccaucaugcggagcgacgccccgaucgggaccugcuccucggagugcaucacgcccaacggcuccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucucggagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccagaucaagggggucgagcucaagucgggcuacaaggacuggauccuguggaucuccuucgccaucagcugcuuccugcugugcgugguccuccugggcuucaucaugugggccugccagaaggggaacauccggugcaacaucugcaucuga

SEQ ID NO: 8892 - RNA, 1701 nt, Artificial Sequence
  derived and/or modified CDS sequence (AUadapt) from InfluenzaA__AFH00175__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgucaagucguucuucucccggcucaacuggcugcacaagcuggaguacaaguaccccgcgcucaacgugaccaugcccaacaacggcaaguucgacaagcuguacaucuggggcgugcaccaccccagcaccgacuccgaccagacgucgcuguacgugcgcgccuccgggcgggucaccgugagcaccaagaagucccagcagaccgugaucccgaacaucggcucccgccccuggguccgggggcagucgucccgcaucagcaucuacuggacgaucgugaagcccggcgacauccuccugaucaacuccaccgggaaccugaucgcgccccggggcuacuucaagauccgcaacggcaagucguccaucaugcggagcgacgccccgaucgggaacugcuccucggagugcaucacccccaacggcuccauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugguggacgggugguacggcuuccgccaccagaacagcgaggggaccggccaggccgccgaccugaaguccacgcaggcggccaucgaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgguuccagaucaagggcguggagcucaagucgggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 8893 - RNA, 1701 nt, Artificial Sequence
  derived and/or modified CDS sequence (AUadapt) from InfluenzaA__AFH00186__HA
augaagaccaucaucgcccugucgcacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaucaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccucgaccgacuccgaccagacgagccuguacgugcgcgccuccggccgggucaccgugucgaccaagcgcagccagcagaccgugacgccgaacaucgggucccggcccuggguccgcggccagucgucccggaucagcaucuacuggaccaucgugaagcccggggacauccuccugaucuccucgaccggcaaccugaucgcgccccgcggcuacuucaagauccggaacgggaaguccagcaucaugcgcuccgacgugccgaucggcaacugcucguccgagugcaucacccccaacgggagcauccccaacgacaagcccuuccagaacgucaaccggaucacguacggcgccugcccgcgcuacgugaagcagaacacccucaagcuggccaccgggaugcggaacgugcccgagaagcagacccgcggcaucuucggcgccaucgccggguucaucgagaacggcugggaggggauggucgacggcugguacggguuccggcaccagaacuccgagggcacgggccaggccgccgaccugaaguccacccaggccgcgaucgaccagaucaacgggaagcucaaccgccugaucgagaagaccaacgagaaguuccaccagaucgagaaggaguucuccgagguggagggccggauccaggaccuggagaaguacguggaggacaccaagaucgaccucuggucguacaacgccgagcugaucgucgcccuggagaaccagcacacgaucgaccucaccgacuccgagaugaacaagcuguucgagaagacccgcaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaagggcgucgagcugaaguccggguacaaggacuggauccuguggaucucguucgccaucagcugcuuccuccugugcguggugcugcucggcuucaucaugugggccugccagaaggggaacauccgcugcaacaucugcaucuga

SEQ ID NO: 8894 - RNA, 1701 nt, Artificial Sequence
  derived and/or modified CDS sequence (AUadapt) from InfluenzaA__AFH00197__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccagcuccggcacgcuggaguucaucaacgaggacuucaacuggaccgggguggcccaggacggcgggucguacacgugcaagcgcggcuccgugaacagcuucuucucccggcucaacuggcugcacaagcuggaguacaaguaccccgcccucaacgucaccaugcccaacaacgggaaguucgacaagcuguacaucuggggcgugcaccaccccucgaccgacuccgaccagaccagccuguacgugcgcgcguccggccgggucaccgugagcaccaagaucucgcagcagacggugaucccgaacaucgggucccgccccuggguccggggccucagcucccgcaucucgaucuacuggaccaucgugaagcccggggacauccugcugaucaacuccaccggcaaccucaucgcgccccggggcuacuucaagauccgcaacgggaaguccuccaucaugcggagcgacgccccgaucggcaacugcuccagcgagugcaucacccccaacggguccauccccaacgacaagcccuuccagaacgugaaccgcaucacguacggcgccugcccgcgguacgucaagcagaacacccugaagcuggccaccgggaugcgcaacgugcccgagaagcagacccggggcaucuucggcgccaucgccggguucaucgagaacggcugggaggggaugguggacggcugguacggguuccgccaccagaacucggagggcacgggccaggccgccgaccucaaguccacccaggccgcgaucgaccagaucaacgggaagcugaaccggcugaucgagaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacucggagaugaacaagcuguucgagcggacccgcaagcagcuccgcgagaacgccgaggacauggggaacggcugcuucaagaucuaccacaagugcgacaacgccugcaucggguccauccggaacggcaccuacgaccacgacgucuaccgcgacgaggcgcugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 8895 - RNA, 1701 nt, Artificial Sequence
  derived and/or modified CDS sequence (AUadapt) from InfluenzaA__AFH00208__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagaacggcgacagcuacgccugcaagcgcggguccgugaaguccuucuucucccggcucaacuggcugcacgagucggaguacaaguaccccgcgcugaacgucaccaugcccaacaacgacaaguucgacaagcucuacaucuggggcgugcaccaccccuccaccgaccgcgagcagacgagccuguacauccgggccuccgggcgcgugaccgucucgaccaagcggagccagcagaccgugaucccgaacaucggcucccgccccugggugcggggccugucgucccgcaucagcaucuacuggacgaucgucaagcccggggacauccuccugaucaacuccaccggcaaccugaucgcgccccggggguacuucaagauccgcaccggcaagucguccgugaugcggagcgacgccccgaucgggaccugcuccucggagugcaucacgcccaacggcuccauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucucgcggcugaucgagaagaccaacgagaaguuccaccagaucgagaaggaguucuccgaggucgagggccgcauccaggaccuggagaaguacguggaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgcgugcaucgggucgauccgcaacggcacguacgaccacgacgucuaccgggacgaggcccugaacaaccgcuuccagaucaaggggguggagcugaaguccggcuacaaggacuggauccucuggaucagcuucgccaucagcugcuuccugcugugcgucgugcuccugggcuucaucaugugggccugccagaaggggaacauccggugcaacaucugcaucuga

SEQ ID NO: 8896 - RNA, 1701 nt, Artificial Sequence
  derived and/or modified CDS sequence (AUadapt) from InfluenzaA__AFH00219__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggaccccaacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccucgacggacuccgaccagaccagccuguacgugcgcgccuccggccgggucaccgugucgaccaagcgcucgcagcagacggugaccccgaacaucgggucccggcccuggguccgcggccucagcucccggaucucgaucuacuggaccaucgugaagcccggggacauccugcugaucaacuccaccggcaaccucaucgcgccccgcggcuacuucaagauccggaacgggaaguccuccaucaugcgcagcgacgccccgaucggcacgugcuccucggagugcaucacccccaacggguccauccccaacgacaagcccuuccagaacgugaaccggaucaccuacggcgccugcccgcgcuacgucaagcagaacacccugaagcuggccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccucaaguccacccaggcggccaucgaccagaucaacgggaagcugaaccgccugaucgacaagacgaacgagaaguuccaccagaucgagaaggaguucucggaggucgagggccggauccaggaccucgagaaguacguggaggacaccaagaucgaccugugguccuacaacgccgagcugcucguggcccuggagaaccagcacaccaucgaccugaccgacagcgagaugaacaagcuguucgagaagacgcgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 8897 - RNA, 1701 nt, Artificial Sequence
  derived and/or modified CDS sequence (AUadapt) from InfluenzaA__AFH00230__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaaguccuucuucucccggcucaacuggcugcacaagcuggaguacaaguaccccgcgcucaacgucaccaugcccaacaacggcaaguucgacaagcuguacaucuggggcgugcaccaccccagcaccaacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 8898 - RNA, 1701 nt, Artificial Sequence; identical to SEQ ID NO: 1269
  derived and/or modified CDS sequence (AUadapt) from InfluenzaA__AFH00241__HA

SEQ ID NO: 8899 - RNA, 1701 nt, Artificial Sequence
  derived and/or modified CDS sequence (AUadapt) from InfluenzaA__AFH00252__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacgacuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccggcguggcccagagcggggacuccuacgccugcaagcgcggcucggugaaguccuucuucagccggcucaacuggcugcacgaguccgaguacaaguaccccgcgcugaacgucaccaugcccaacaacgacaaguucgacaagcucuacaucuggggcgugcaccaccccucgaccgaccgcgagcagacgucccuguacauccgggccagcggccgcgugaccgucucgaccaagcggucccagcagaccgugaucccgaacaucgggagccgccccugggugcggggccuguccucgcgcaucuccaucuacuggacgaucgucaagcccggcgacauccuccugaucaacagcaccgggaaccugaucgcgccccggggcuacuucaagauccgcaccgggaaguccucgaucaugcgguccgacgccccgaucgggaccugcagcuccgagugcaucacgcccaacggcucgauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccugaaguccacccaggcggccaucgaccagaucaacgggaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 8900 - RNA, 1701 nt, Artificial Sequence
  derived and/or modified CDS sequence (AUadapt) from InfluenzaA__AFH00263__HA
augaagaccaucaucgcccugucguacauccuccaccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggaccccaacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccucgacggacuccgugcagaccagccuguacguccgcgccuccggcaaggugaccgugucgaccaagcggucgcagcagacggucaccccgaacaucggguccaagcccugggugcgcggccucagcucccggaucucgaucuacuggaccaucgugaagcccggggacauccugcugaucaacuccaccggcaaccucaucgcgccccgcggcuacuucaagauccggaacgggaaguccuccaucaugcgcagcgacgccccgaucggcacgugcuccucggagugcaucacccccaacggguccauccccaacgacaagcccuuccagaacgucaaccggaucaccuacggcgccugcccgcgcuacgugaagcagaacacccugaagcuggccacggggaugcggaacgugcccgagaagcagacccgcggcaucuucggcgccaucgccggguucaucgagaacggcugggaggggauggucgacggcugguacggguuccggcaccagaacagcgagggcaccggccaggccgccgaccucaaguccacccaggcggccaucgaccagaucaacgggaagcugaaccgccugaucgagaagacgaacgagaaguuccaccagaucgagaaggaguucucggagguggagggccggauccaggaccucgagaaguacguggaggacaccaagaucgaccugugguccuacaacgccgagcugcucgucgcccuggagaaccagcacaccaucgaccugaccgacagcgagaugaacaagcuguucgagaagacgcgcaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggcgucgagcucaagucgggguacaaggacuggauccuguggaucuccuucgccaucagcugcuuccugcucugcguggugcugcugggcuucaucaugugggccugccagaaggggaacauccgcugcaacaucugcaucuga

SEQ ID NO: 8901 - RNA, 1701 nt, Artificial Sequence
  derived and/or modified CDS sequence (AUadapt) from InfluenzaA__AFH00274__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagcggcaucuccaucuacuggacgaucgugaagcccggggacauccugcugaucaacucgaccggcaaccucaucgcgccccggggcuacuucaagauccgcaacgggaaguccagcaucaugcgguccgacgccccgaucggcaacugcucguccgagugcaucacccccaacgggagcauccccaacgacaagcccuuccagaacgugaaccgcaucaccuacggcgccugcccgcgguacgucaagcagaacacgcugaagcuggccaccgggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagagcacgcaggcggccaucgaccagaucaacgggaagcugaaccggcugaucgagaagaccaacgagaaguuccaccagaucgagaaggaguucuccgaggucgagggccgcauccaggaccucgagaaguacguggaggacaccaagaucgaccuguggucguacaacgccgggcugcucguggcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgcgugcaucggcagcauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 8902 - RNA, 1701 nt, Artificial Sequence
  derived and/or modified CDS sequence (AUadapt) from InfluenzaA__AFH00285__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcggcucgccccaccggauccuggacgggaagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaucaacgaggacuucaacuggaccggcguggcccaggacgggggcucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugucgaccaagcgcucgcagcagaccgugacgccgaacaucggcucccggcccuggguccgcgggcagagcucccggaucucgaucuacuggaccaucgugaagcccggcgacauccuccugaucaacuccaccggcaaccugaucgcgccccgcggguacuucaagauccggaacggcaagagcuccaucaugcgcucggacgccccgaucgggaacugcuccagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcggcaucuucggggccaucgccggcuucaucgagaacgggugggagggcaugguggacgggugguacggcuuccggcaccagaacucggagggcacggggcaggccgccgaccugaaguccacccaggcggccaucgaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacucggagaugaacaagcuguucgagaagacccgcaagcagcuccgcgagaacgccgaggacaugggcaacgggugcuucaagaucuaccacaagugcgacaacgcgugcaucggcuccauccggaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcgucgugcuccugggguucaucaugugggccugccagaagggcaacauccgcugcaacaucugcaucuga

SEQ ID NO: 8903 - RNA, 1701 nt, Artificial Sequence
  derived and/or modified CDS sequence (AUadapt) from InfluenzaA__AFH00296__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacgaguccgaguacaaguaccccgcgcugaacgucaccaugcccaacaacgggaaguucgacaagcuguacaucuggggcgugcaccaccccucgaccgaccgcgagcagacgaaccucuacgugcgggccuccggccgcgucaccgugagcaccaagcggucgcagcagaccgugaucccgaacaucgggucccgccccuggguccggggccugagcucccgcaucucgaucuacuggacgaucgugaagcccggggacauccugcucaucaacuccaccggcaaccugaucgcgccccggggcuacuucaagauccgcaccggcaagagcuccaucaugcggucggacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacucggagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaccagcugcuuccuccugugcgucgugcugcucggcuucaucaugugggccugccagaaggggaacauccggugcaacaucugcaucuga

SEQ ID NO: 8904 - RNA, 1701 nt, Artificial Sequence
  derived and/or modified CDS sequence (AUadapt) from InfluenzaA__AFH00307__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaucaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccucgaccgacuccgaccagacgagccuguacgugcgcgccuccggccgggucaccgugucgaccaagcgcucgcagcagaccgugacgccgaacaucgggucccggcccuggguccgcggccagagcucccggaucucgaucuacuggaccaucgugaagcccggggacauccuccugaucaacuccaccggcaaccugaucgcgccccgcggcuacuucaagauccggaacgggaaguccuccaucaugcgcagcgacgccccgaucggcaacugcuccucggagugcaucacccccaacggguccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggcgccaucgccggguucaucgagaacggcugggaggggaugguggacggcugguacggguuccggcaccagaacagcgagggcacgggccaggccgccgaccugaaguccacccaggcggccaucgaccagaucaacgggaagcucaaccgccugaucgagaagaccaacgagaaguuccaccagaucgagaaggaguucucggaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcugugcgucgugcuccugggcuucaucaugugggccugccagaaggggaacauccgcugcaacaucugcaucuga

SEQ ID NO: 8905 - RNA, 1701 nt, Artificial Sequence; identical to SEQ ID NO: 8904
  derived and/or modified CDS sequence (AUadapt) from InfluenzaA__AFH00318__HA

SEQ ID NO: 8906 - RNA, 1701 nt, Artificial Sequence
  derived and/or modified CDS sequence (AUadapt) from InfluenzaA__AFH00329__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucccaccaccggauccuggacggcaagaacugcacccugaucgacgcccuccugggggacccccacugcgacggcuuccagaacaaggagugggaccuguucguggagcgcucgaaggccuacuccaacugcuaccccuacgacgugcccgacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguacccggcgcucaacgucaccaugcccaacaacggcaaguucgacaagcuguacaucuggggcgugcaccaccccagcaccgacuccgaccagacgucgaucuacgugcgcgccuccgggcgggucaccgugagcaccaagcgcucgcagcagaccgugauccccaacaucggcucccggccguggguccgcgggaucagcucccggaucucgaucuacuggacgaucgugaagcccggcgacauccugcucaucaacuccaccgggaaccugaucgcgccccgcggcuacuucaagauccggaacggcaagagcuccaucaugcgcucggacgcccccaucgggaacugcaacuccgagugcaucaccccgaacggcagcauccccaacgacaagcccuuccagaacgugaaccggaucaccuacggggccugcccccgcuacgucaagcagaacacgcugaagcucgccaccggcaugcggaacgugccggagaagcagacccgcgggaucuucggcgccaucgccggcuucaucgagaacgggugggagggcaugguggacgggugguacggcuuccggcaccagaacuccgaggggaccggccaggccgccgaccucaagucgacgcaggcggccaucgaccagaucaacggcaagcugaaccgccugaucgagaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucacggacuccgagaugaacaagcuguucgagcgcacccgcaagcagcugcgggagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaccuccugcuuccuccugugcgucgugcugcucggguucaucaugugggccugccagaagggcaacauccggugcaacaucugcaucuga

SEQ ID NO: 8907 - RNA, 1701 nt, Artificial Sequence
  derived and/or modified CDS sequence (AUadapt) from InfluenzaA__AFH00340__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcuuccggcccuggguccgcgggcucuccagccggaucuccaucuacuggacgaucgugaagcccggcgacauccugcugaucucguccaccgggaaccucaucgcgccccgcggcuacuucaagauccggaacggcaagagcuccaucaugcgcagcgacgccccgaucgggaacugcuccucggagugcaucacccccaacggcuccauccccaacgacaagcccuuccagaacgugaaccggaucaccuacggggccugcccgcgcuacgucaagcagaacacgcugaagcuggccaccggcaugcggaacauccccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgagguggaggggcggauccaggaccucgagaaguacgucgaggacaccaagaucgaccugugguccuacaacgccggccugcucguggcccuggagaaccagcacaccaucgaccugacggacucggagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggcgucgagcucaagagcggguacaaggacuggauccuguggaucuccuucgccaucagcugcuuccugcucugcgugguccugcugggcuucaucaugugggccugccagaaggggaacauccggugcaacaucugcaucuga

SEQ ID NO: 8908 - RNA, 1701 nt, Artificial Sequence
  derived and/or modified CDS sequence (AUadapt) from InfluenzaA__AFH00351__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaaggagggguucaacuggaccggcguggcccaggacgggaaguccuacgccugcaagcgcggcuccgucaagucguucuucucccggcucaacuggcugcacaagcuggaguacaaguaccccgcgcucaacgugaccaugcccaacaacgacaaguucgacaagcuguacaucuggggcgugcaccaccccagcacggacuccgaccagaccucgcuguacgugcaggccuccgggcgcgucaccgugagcaccaagcggucgcagcagacggugaucccgaacaucggcucccgccccuggguccgggggaucagcucccgcaucucgaucuacuggaccaucgugaagcccggcgacauccuccugaucaacuccaccgggaaccugaucgcgccccggggcuacuucaagauccgcaacggcaagagcuccaucaugcggucggacgccccgaucgggaacugcaacuccgagugcaucacccccgacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaucgaccagaucaacggcaagcugaaccggcugaucgagaagaccaacaagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 8909 - RNA, 1701 nt, Artificial Sequence
  derived and/or modified CDS sequence (AUadapt) from InfluenzaA__AFH00362__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgagggguucaacuggaccggcguggcccaggacgggaaguccuacgccugcaagcgcggcuccgucaagucguucuucucccggcucaacuggcugcacaagcuggaguacaaguaccccgcgcucaacgugaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagauccgcaacggcaagucguccaucaugcggucggacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagucgacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgguuccagaucaaggggguggagcugaaguccggcuacaaggacuggauccucuggaucagcuucgccacguccugcuuccugcugugcgucgugcuccugggcuucaucaugugggccugccagaaggggaacauccgcugcaacaucugcaucuga

SEQ ID NO: 8910 - RNA, 1701 nt, Artificial Sequence
  derived and/or modified CDS sequence (AUadapt) from InfluenzaA__AFH00384__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaucgggaaccugaucgcgccccggggcuacuucaagauccgcaacggcaagucguccaucaugcggagcgacgccccgaucgggaacugcaacuccgagugcaucacccccaacggcucgauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggucguacaacgccggccugcugguggcccucgagaaccagcacaccaucgaccugacggacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcugaaguccggguacaaggacuggauccucuggaucagcuucgccaucuccugcuuccugcugugcgucgugcuccugggcuucaucaugugggccugccagaaggggaacauccgcugcaacaucugcaucuga

SEQ ID NO: 8911 - RNA, 1701 nt, Artificial Sequence
  derived and/or modified CDS sequence (AUadapt) from InfluenzaA__AFH00395__HA
augaaggccaucaucgcccugucguacauccucugccugguguucgcgcagaagcugcccggcaacgacaacuccaccgccacccucugccuggggcaccacgccgucccgaacggcacgcuggugaagaccaucaccaacgaccagaucgaggugaccaacgccacggagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggcguacuccaacugcuaccccuacgacgugccggacuacgccucgcuccggucccuggucgccagcuccggcacccuggaguucacgaaggagggguucaacuggaccggcguggcccaggacgggaaguccuacgcgugcaagcgcggcuccgugaacggguucuucucgcggcucaacuggcugcacaagcuggaguacaaguaccccgcccucaacgucaccaugcccaacaacgacaaguucgacaagcuguacaucuggggcgugcaccaccccuccaccgacucggaccagacgucccuguacgugcaggccagcggccgcgucaccguguccaccaagcggucgcagcagaccgugaucccgaacaucgggagccgccccuggguccggggcaucuccucgcgcaucuccaucuacuggacgaucgugaagcccggggacauccuccugaucaagagcaccggcaaccugaucgcgccccggggcuacuucaagauccgcaacgggaaguccucgaucaugcgguccgacgccccgaucggcaacugcaacucggagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgcggaccugaaguccacgcaggccgccaucgaccagaucaacgggaagcucaaccggcugaucgagaagaccaacgagaaguuccaccagaucgagaaggaguucucggaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgcggaggacauggggaacggcugcuucaagaucuaccacaagugcgacaacgccugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcugugcgucgugcuccugggcuucaucaugugggccugccagaaggggaacauccgcugcaacaucugcaucuga

SEQ ID NO: 8912 - RNA, 1701 nt, Artificial Sequence
  derived and/or modified CDS sequence (AUadapt) from InfluenzaA__AFH00417__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgagggguucaacuggaccggcguggcccaggacgggaaguccuacgccugcaagcgcggcuccgucaagucguucuucucccggcucaacuggcugcacaagcuggaguacaaguaccccgcgcucaacgugaccaugcccaacaacgacaaguucgacaagcuguacaucuggggcgugcaccaccccagcacggacuccgaccagaccucgcuguacgugcaggccuccgggcgcgucaccgugagcaccaagcggucgcagcagacggugaucccgaacaucggcucccgccccuggguccgggggaucagcucccgcaucucgaucuacuggaccaucgugaagcccggcgacauccuccugaucaacuccaccgggaaccugaucgcgccccggggcuacuucaagauccgcaacggcaagagcuccaucaugcggucggacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagucgacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 8913 - RNA, 1701 nt, Artificial Sequence; identical to SEQ ID NO: 1233
  derived and/or modified CDS sequence (AUadapt) from InfluenzaA__AFH00428__HA

SEQ ID NO: 8914 - RNA, 1701 nt, Artificial Sequence
  derived and/or modified CDS sequence (AUadapt) from InfluenzaA__AFH00439__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccuccugaucaacuccaccgggaaccugaucgcgccccggggcuacuucaagauccgcucgggcaaguccagcaucaugcgguccgacgccccgaucgggaacugcaacucggagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucucggagguggaggggcgcauccaggaccuggagaaguacguggaggacacgaagaucgaccucugguccuacaacgccgagcugcuggucgcccucgagaaccagcacaccaucgaccugaccgacagcgagauguccaagcuguucgagcggacccgcaagcagcuccgcgagaacgccgaggacaugggcaacgggugcuucaagaucuaccacaagugcgacaacgcgugcaucggcucgauccggaacgggacguacgaccacgacguguaccgcgacgaggcccugaacaaccgguuccagaucaagggcgucgagcugaaguccggcuacaaggacuggauccucuggaucagcuucgccaucagcugcuuccugcugugcguggugcuccugggguucaucaugugggccugccagaagggcaacauccgcugcaacaucugcaucuga

SEQ ID NO: 8915 - RNA, 1701 nt, Artificial Sequence
  derived and/or modified CDS sequence (AUadapt) from InfluenzaA__AFH00450__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacggcccccaccggaucaucgacgggaagaacugcacccugaucgacgcccugcucggcgacccccacugcgacggcuuccagaacaaggagugggaccuguucguggagcgcuccaaggccuacagcaacugcuaccccuacgacgugccggacuacgcgucccugcggucgcucgucgccuccagcgggacgcuggaguucaccaacgaguccuucaacuggaccggcguggcccagaacgggaccucguacgccugcaagcgcggcuccgucaagagcuucuucucccggcugaacuggcuccacaagcuggaguacaaguaccccgcgcugaacgugacgaugcccaacaacgacaaguucgacaagcucuacaucuggggcgugcaccaccccucgaccgacuccgaccagaccagccuguacgugcaguccucggggcgcgucaccgugagcacgaagcggucccagcagaccgugaucccgaacaucggcucgcgccccuggguccgcgggguguccagccggaucuccaucuacuggaccaucgugaagcccggcgacauccugcucaucaacucgaccgggaaccugaucgcgccccggggcuacuucaagauccgcuccggcaagagcuccaucaugcggucggacgccccgaucgacaacugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggaugaucgacggcugguacggguuccgccaccagaacuccgagggcaccgggcaggccgccgaccucaagucgacccaggccgcgaucaaccagaucaacggcaagcugaaccggcugaucgagaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagcggacccgcaagcagcugcgcgagaacgccgaggacauggggaacggcugcuucaagaucuaccacaagugcgacaacgccugcaucgggucgauccggaacggcacguacgaccacgacgucuaccgcgacgaggcgcucaacaaccgguuccagaucaaggggguggagcugaaguccggcuacaaggacuggauccuguggaucagcuucgccaucagcugcuuccuccugugcgucgugcugcucggcuucaucaugugggccugccagaaggggaacauccgcugcaacaucugcaucuga

SEQ ID NO: 8916 - RNA, 1701 nt, Artificial Sequence
  derived and/or modified CDS sequence (AUadapt) from InfluenzaA__AFH00461__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccucgggcacgcuggaguucaucaacgagaacuucaacuggaccgggguggcccaggacggcaaguccuacgccugcaagcgcgggagcgugaacuccuucuucucgcggcucaacuggcugcacaagcuggacuacaaguaccccgcgcucaacgucaccaugcccaacaacggcaaguucgacaagcuguacaucuggggcgugcaccacccguccaccgacagcgaccagaucucccuguacgugcgcagcuccgggcgggucacggugucgaccaagcgcagccagcagaccgugauccccgacaucggcuaccggcccuggguccgcgggcucuccagccggaucuccaucuacuggaccaucgugaagcccggcgacauccugcugaucaacucgacggggaaccucaucgccccgcgcggcuacuucaagcugcggaacggcaaguccagcaucaugcgcuccgacgcccccaucgggaacugcucguccggcugcaucacccccaacgggagcauccccaacgacaagccguuccagaacgugaaccggaucaccuacggcgccugcccccgcuacgucaagcagaacacccugaagcucgccacggggaugcggaacgugcccgagaagcagacccgcggcaucuucggcgcgaucgccggguucaucgagaacggcugggaggggaugguggacggcugguacggguuccggcaccagaacuccgagggcaccggccaggccgccgaccucaagagcacccaggccgcgaucgaccagaucaacgggaagcugaaccgccuggucgagaagacgaacgagaaguuccaccagaucgagaaggaguucuccgagguggagggccggauccaggaccuggagaaguacguggaggacaccaagaucgaccuguggucguacaacgccgagcuccuggucgcccuggagaaccagcacaccaucgaccucaccgacuccgagaugaacaagcuguucgagcgcacgcgcaagcagcugcgggagaacgccgaggacauggggaacggcugcuucaagaucuaccacaagugcgacaacgccugcaucgggagcauccgcaacggcaccuacgaccacgacguguaccgggacgaggcgcucaacaaccgcuuccagaucaagggcgucgagcugaaguccggguacaaggacuggauccuguggaucagcuucgccaucuccugcuuccuccugugcguggugcugcucggcuucaucaugugggccugccagaaggggaacauccggugcaacaucugcaucuga

SEQ ID NO: 8917 - RNA, 1701 nt, Artificial Sequence
  derived and/or modified CDS sequence (AUadapt) from InfluenzaA__AFH00472__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugagcgacuacgcgucccuccggucgcuggucgccuccagcggcacgcuggaguucaacaacgaguccuucaacuggaccgggguggcccagaacggcaccagcuacgccugcaagcgccgguccgugaaguccuucuucucccgccucaacuggcugcacaagcuggaguacaaguacccggcgcucaacgucaccaugcccaacaacgacaaguucgacaagcuguacaucuggggcgugcaccaccccucgacggacuccgaccagaccagccuguacgugcaggccucggggcgggucaccguguccaccaagcgcagccagcagacggugauccccaacaucgggucccggccguggguccgcggcgugucgucccggaucagcaucuacuggaccaucgugaagcccggcgacauccuccugaucaacuccaccgggaaccugaucgcgccccgcggcuacuucaagauccggagcgggaaguccucgaucaugcgcuccgacgcccccaucggcaacugcaacagcgagugcaucaccccgaacggcuccauccccaacgacaagcccuuccagaacgucaaccggaucacguacggggccugcccccgcuacgugaagcagaacacccucaagcuggccaccggcaugcggaacgugccggagaagcagacccgcgggaucuucggcgccaucgccggguucaucgagaacggcugggagggcauggucgacgggugguacggcuuccggcaccagaacucggaggggacgggccaggccgccgaccugaaguccacccaggcggccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcguggugcuccugggcuucaucaugugggccugccagaagggcaacauccggugcaacaucugcaucuga

SEQ ID NO: 8918 - RNA, 1701 nt, Artificial Sequence
  derived and/or modified CDS sequence (AUadapt) from InfluenzaA__AFH00483__HA
augaagaccaucaucgcccugucguacauccucugcaugguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggaagaucugcgacagcccccaccgcauccucgacggcaagaacugcacccugaucgacgcccugcucggggacccccacugcgacggcuuccagaacaaggagugggaccuguucguggagcggucgaaggccuacuccaacugcuaccccuacgacgugccggacuacgcgagccugcgcucccucgucgccucguccggcacgcuggaguucaacaacgagagcuucaacuggaccgggguggcccagaacggcaccuccuacgccugcaagcgggggucggugaaguccuucuucagccgccugaacuggcuccacaagcuggaguacaaguaccccgcgcugaacgucaccaugcccaacaacgacaaguucgacaagcucuacaucuggggcgugcaccaccccuccacggacucggaccagaccucccuguacgugcaggccagcgggcgggucaccgugucgaccaagcgcucccagcagacggugaucccgaacaucggcagccggcccuggguccgcggcguguccucgcggaucuccaucuacuggaccaucgugaagcccggggacauccugcucaucaacagcaccggcaaccugaucgcgccccgcggguacuucaagauccgguccggcaagucguccaucaugcgcagcgacgccccgaucggcaacugcaacuccgagugcaucacccccaacgggucgauccccaacgacaagcccuuccagaacgucaaccggaucacguacggcgccugcccgcgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacuccgagggcacggggcaggccgccgaccugaaguccacccaggcggccaucaaccagaucaacggcaagcugaaccgccucaucgagaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcacccggaagcagcugcgcgagaacgccgaggacauggggaacggcugcuucaagaucuaccacaagugcgacaacgcgugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucagcugcuuccuccugugcguggugcugcucggcuucaucaugugggccugccagaaggggaacauccggugcaacaucugcaucuga

SEQ ID NO: 8919 - RNA, 1701 nt, Artificial Sequence
  derived and/or modified CDS sequence (AUadapt) from InfluenzaA__AFH00494__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucgucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacucgaacugcuacccguacgacgugcccgacuacgcgucccuccggagccuggucgccuccucgggcacgcuggaguucaucaacgagaacuucaacuggaccgggguggcccaggacggcaaguccuacgccugcaagcgcgggagcgugaacuccuucuucucgcggcucaacuggcugcacaagcuggaguacaaguaccccgcgcucaacgucaccaugcccaacaacggcaaguucgacaagcuguacaucuggggcgugcaccacccguccaccgacagcgaccagacgucccuguacgugcgcgccucggggcgggucaccguguccaccaagcgcucgcagcagaccgugauccccgacaucggcuaccggcccuggguccgcgggcagagcucccggaucggcaucuacuggacgaucgugaagcccggggacauccuccugaucaacucgaccggcaaccugaucgccccgcgcggcuacuucaagauccggaacgggaaguccagcaucaugcgcuccgacgcccccaucggcaacugcucguccgagugcaucacccccaacgggagcauccccaacgacaagccguuccagaacgugaaccggaucaccuacggcgccugcccccgcuacgucaagcagaacacgcucaagcuggcgaccgggaugcggaacgugcccgagaagcagacccgcggcaucuucggcgccaucgccggguucaucgagaacggcugggaggggaugguggacggcugguacggguuccggcaccagaacuccgagggcaccggccaggccgccgaccucaagucgacgcaggcggccaucgaccagaucaacgggaagcugaaccgccuggucgagaagaccaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggucgauccgcaacggcaccuacaaccacgacguguaccgggacgaggcccugaacaaccgcuuccagaucaagggcgucgagcugaaguccggguacaaggacuggauccucuggaucagcuucgccaucuccugcuuccugcugugcguggugcuccugggcuucaucaugugggccugccagaaggggaacauccggugcaacaucugcaucuga

SEQ ID NO: 8920 - RNA, 1701 nt, Artificial Sequence
  derived and/or modified CDS sequence (AUadapt) from InfluenzaA__AFH00505__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccagcuccggcacgcuggaguucaccaacgagggguucaacuggaccggcguggcccaggacgggaccucguacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaucucgcuguacgugcaggccuccgggcgcgucaccgugagcaccaagcggagccagcagacggugaucccgaacaucggcucccgccccuggguccgcggggugucguccaucaucagcaucuacuggaccaucgugaagcccggcgacauccuccugaucaacuccaccgggaaccugaucgcgccccggggcuacuucaagauccggucgggcaaguccagcaucaugcgcuccgacgccccgaucgacaacugcaacagcgagugcaucacccccaacggguccauccccaacgacaagcccuuccagaacgucaaccggaucacguacggcgccugcccgcgcuacgugaagcagaacacccucaagcuggccaccgggaugcggaacgugcccgagaagcagacccgcggcaucuucggggccaucgccggcuucaucgagaacggcugggaggggauggucgacggcugguacggguuccggcaccagaacucggagggcacggggcaggccgccgaccugaaguccacccaggcggccaucaaccagaucaacggcaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacucggagaugaacaagcuguucgagcgcacccggaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 8921 - RNA, 1701 nt, Artificial Sequence
  derived and/or modified CDS sequence (AUadapt) from InfluenzaA__AFH00516__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaccaacgagggguucaacuggaccggcguggcccaggacgggaaguccuacgccugcaagcgcggcuccgugaacucguucuucucccggcugaacuggcuccacaagcuggaguacaaguaccccgcgcugaacgucaccaugcccaacaacgacaaguucgacaagcucuacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccugcucaucaaguccaccgggaaccugaucgcgccccggggcuacuucaagauccgcaacggcaagucguccaucaugcggucggacgccccgaucgacaacugcaacuccgagugcaucacccccaacgggagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagucgacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggacccgcaagcagcugcgcgagaacgccgaggacauggggaacggcugcuucaagaucuaccacaagugcgacaacgcgugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 8922 - RNA, 1701 nt, Artificial Sequence
  derived and/or modified CDS sequence (AUadapt) from InfluenzaA__AFH00527__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaacaacgagucguucaacuggaccgggguggcccagaacggcaccuccuacgccugcaagcgccggucgaucaaguccuucuucagccgccugaacuggcuccaccagcugaaguacaaguaccccgcgcugaacgugaccaugcccaacaacgacaaguucgacaagcucuacaucuggggcguccaccaccccuccacggacucggaccagaccucccuguacgcccaggccagcgggcgggugaccgugucgaccaagcgcucccagcagacggucaucccgaacaucgggagccggcccugggugcgcggcguguccucgcggaucuccauccacuggaccaucgucaagcccggcgacauccugcucaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucucguucgccaucagcugcuuccuccugugcgugguccugcucggcuucaucaugugggccugccagaagggcaacauccggugcaacaucugcaucuga

SEQ ID NO: 8923 - RNA, 1701 nt, Artificial Sequence
  derived and/or modified CDS sequence (AUadapt) from InfluenzaA__AFH00538__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagcgcucguccaccgggcggaucugcgacagcccccaccgcauccucgacggcgagaacugcacccugaucgacgcccugcucggggacccccacugcgacggcuuccagaacaaggagugggaccuguucguggagcgguccaaggccuacucgaacugcuaccccuacgacgugccggacuacgcgucccugcgcagccucgucgccuccucgggcacgcuggaguucaacaacgaguccuucaacuggaccgggguggcccagaacggcaccagcuacgccugcaagcggcgcuccaucaagucguucuucucccggcugaacuggcuccaccagcugaaguacaaguaccccgcgcugaacgugaccaugcccaacaacgacaaguucgacaagcucuacaucuggggcguccaccaccccagcacggacuccgaccagaccucgcuguacgcccaggccuccgggcgcgugaccgugagcaccaagcggucgcagcagacggucaucccgaacaucgggucccgccccugggugcggggcgugucgucccgcaucagcaucuacuggaccaucgucaagcccggcgacauccugcucaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcugaaccggcucaucgagaagaccaacgagaaguuccaccagaucgagaaggaguucucggagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcucaagucgggguacaaggacuggauccuguggaucuccuucgccaucagcugcuuccugcugugcgugguccugcucggcuucaucaugugggccugccagaagggcaacauccgcugcaacaucugcaucuga

SEQ ID NO: 8924 - RNA, 1701 nt, Artificial Sequence
  derived and/or modified CDS sequence (AUadapt) from InfluenzaA__AFH00549__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcgagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccucggccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccucgacggacuccgaccagaccagccuguacgcccaggccccggggcgggugaccgugucgacccgccggucccagcagacggucauccccaacaucgggagccgccccugggugcggggcguguccucgaucaucuccaucuacuggaccaucgucaagcccggcgacauccuccugaucaacagcaccgggaaccugaucgccccgcgcggcuacuucaagauccgguccgggaaguccuccaucaugcgcucggacgcccccaucuccaagugcaacagcgagugcaucacccccaacggcuccauccccaacgacaagccguuccagaacgugaaccggaucacguacggcgcgugcccccgcuacgugaagcagaacacccucaagcuggccaccgggaugcggaacguccccgagaagcagacccgcggcaucuucggggccaucgccggcuucaucgagaacgggugggagggcaugguggacggcugguacggguuccggcaccagaacucggagggcacggggcaggccgcggaccugaaguccacccaggccgccaucaaccagaucaacggcaagcucaaccgccugaucgagaagaccaacgagaaguuccaccagaucgagaaggaguucagcgagguggaggggcggauccaggaccuggagaaguacgucgaggacaccaagaucgaccucugguccuacaacgccgagcugcugguggcccucgagaaccagcacacgaucgaccugaccgacucggagaugaacaagcuguucgagcgcacccgcaagcagcuccgggagaacgcggaggacaugggcaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucagcuucgccaucuccugcuuccugcugugcgugguccuccugggguucaucaugugggccugccagaagggcaacauccggugcaacaucugcaucuga

SEQ ID NO: 8925 - RNA, 1701 nt, Artificial Sequence
  derived and/or modified CDS sequence (AUadapt) from InfluenzaA__AFH00560__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacaucccccaccagauccuggacggggagaacugcacccugaucgacgcccuccugggcgacccccacugcgacggguuccagaacaaggagugggaccuguucguggagcgguccacggccuacagcaacugcuaccccuacgacgucccggacuacgcgucccuccgcucgcugguggccuccagcggcacccuggaguucaacaacgaguccuucaacuggaccggcguggcccagaacgggaccucguccgccugcaagcggcgcagcaucaaguccuucuucucgcggcucaacuggcugcaccagcugaaguacaaguaccccgcgcucaacgucacgaugcccaacaacgagaaguucgacaagcuguacaucuggggcgugcaccaccccuccaccgacagcgaccagaucucccuguacgcccaggccccggggcgcgugaccgucucgaccaagcggagccagcagacggugauccccaacaucggcucccgccccugggugcgcggggucucgucccggaucagcaucuacuggaccaucgugaagcccggcgacauccuccugaucaacuccaccggcaaccugaucgccccgcggggguacuucaagauccgcucgggcaaguccagcaucaugcgguccgacgcccccaucgggaagugcaacucggagugcaucacccccaacggcuccauccccaacgacaagccguuccagaacgugaaccgcaucacguacggcgcgugcccccgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggccgaggggcgcauccaggaccuggagaaguacgucgaggacaccaagaucgaccucugguccuacaacgccgagcugcugguggcgcucgagaaccagcacacgaucgaccugaccgacagcgagaugaacaagcuguucgagcggacccgcaagcagcuccgcgagaacgccgaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcucaagucgggcuacaaggacuggauccuguggaucuccuucgccaucagcugcuuccugcugugcaucgugcuccugggguucaucaugugggcgugccagaagggcaacauccgcugcaacaucugcaucuga

SEQ ID NO: 8926 - RNA, 1701 nt, Artificial Sequence
  derived and/or modified CDS sequence (AUadapt) from InfluenzaA__AFH00571__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgacaacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggaccagaacgggaccuccucggccugcaagcggcgcuccaacaagagcuucuucucccggcucaacuggcugcaccagcugaaguacaaguaccccgcccucaacgucacgaugcccaacaacgagaaguucgacaagcuguacaucuggggcgugcaccaccccucgaccgacuccgaccagaucagccuguacgcgcaggccucggggcgcgugaccgucuccaccaagcggagccagcagacggugaucccgaacaucggcucccgccccugggugcgcggggucucgucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgccgaccugaaguccacccaggcggccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 8927 - RNA, 1701 nt, Artificial Sequence
  derived and/or modified CDS sequence (AUadapt) from InfluenzaA__AFH00582__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccccggggcgggugaccgugucgaccaagcgcucccagcagaccgucauccccaacaucggcagccggcccugggugcgcggcguguccucgcggaucuccaucuacuggacgaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaccagcugcuuccugcugugcgugguccuccugggcuucaucaugugggccugccagaaggggaacauccgcugcaacaucugcaucuga

SEQ ID NO: 8928 - RNA, 1701 nt, Artificial Sequence; identical to SEQ ID NO: 1550
  derived and/or modified CDS sequence (AUadapt) from InfluenzaA__AFH00593__HA

SEQ ID NO: 8929 - RNA, 1701 nt, Artificial Sequence; identical to SEQ ID NO: 1550
  derived and/or modified CDS sequence (AUadapt) from InfluenzaA__AFH00604__HA

SEQ ID NO: 8930 - RNA, 1701 nt, Artificial Sequence
  derived and/or modified CDS sequence (AUadapt) from InfluenzaA__AFH00615__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcaacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugagcacgaagcgcucccagcagaccgugaucccgaacaucggcucgcggccccgcguccgggacaucuccucgcgcaucuccaucuacuggaccaucgugaagcccggggacauccugcucaucaacagcaccggcaaccugaucgcgccccggggguacuucaagauccgcuccggcaagucguccaucaugcggucggacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagucgacccaggcggccaucaaccagaucaacggcaagcugaaccggcucaucggcaagaccaacgagaaguuccaccagaucgagaaggaguucuccgaggucgaggggcgcauccaggacaucgagaaguacguggaggacacgaagaucgaccuguggucguacaacgccgagcugcucguggcccuggagaaccagcacaccaucgaccugaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacgucuaccgggacgaggcccugaacaaccgcuuccagaucaaggggguggagcucaaguccggcuacaaggacuggauccuguggaucucguucgccaucagcugcuuccugcucugcguggcccugcugggcuucaucaugugggccugccagaaggggaacauccggugcaacaucugcaucuga

SEQ ID NO: 8931 - RNA, 1701 nt, Artificial Sequence; identical to SEQ ID NO: 8522
  derived and/or modified CDS sequence (AUadapt) from InfluenzaA__AFH00626__HA

SEQ ID NO: 8932 - RNA, 1701 nt, Artificial Sequence
  derived and/or modified CDS sequence (AUadapt) from InfluenzaA__AFH00637__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagagcuucaacuggaccggcgugacccagaacgggaccuccucguccugcaagcgccggagcaacaacuccuucuucucgcgccugaacuggcucacgcaccugaaguucaaguaccccgcccugaacgugaccaugcccaacaacgagaaguucgacaagcucuacaucuggggcguccaccaccccgggaccaacaacgaccagaucucccuguacacccaggccucgggccggaucacggugagcaccaagcgcucccagcagaccgugaucccgaacaucggcucgcggccccgcguccgggacauccccucccgcaucagcaucuacuggaccaucgugaagcccggggacauccugcucaucaacuccacgggcaaccugaucgcgccgcggggguacuucaagauccgcucgggcaaguccucgaucaugcgguccgacgcccccaucggcaagugcaacagcgagugcaucacccccaacggguccauccccaacgacaagccguuccagaacgugaaccgcaucaccuacggcgccugcccccgguacgucaagcagaacacccugaagcucgccacggggaugcgcaacgugcccgagaagcagacccggggcaucuucggggccaucgcgggcuucaucgagaacggcugggaggggaugguggacggcugguacggguuccgccaccagaacucggagggcaucgggcaggccgccgaccugaaguccacccaggccgccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgcggagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcugaaguccggcuacaaggacuggauccuguggaucuccuucgcgaucagcugcuuccuccugugcguggcccugcucggguucaucaugugggccugccagaagggcaacauccggugcaacaucugcaucuga

SEQ ID NO: 8933 - RNA, 1701 nt, Artificial Sequence
  derived and/or modified CDS sequence (AUadapt) from InfluenzaA__AFH00648__HA
augaagaccaucaucgcccugucguacauccucugccugguguucgcccagaagcugcccggcaacgacgacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacgacgagagcuucaacuggaccggcgugacccagaacgggaccuccucguccugcaagcgccggagcaacaacuccuucuucucgcgccugaacuggcucacgcaccugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcucgcagcagaccgucaucccgaacaucggcucccggccccgcauccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 8934 - RNA, 1701 nt, Artificial Sequence
  derived and/or modified CDS sequence (AUadapt) from InfluenzaA__AFH00659__HA
augaagaccaucaucgcccugucguacauccucugccugguguucacccagaagcugcccggcaacgacaacuccacggccacccucugccuggggcaccacgcggucccgaacggcaccauggugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcucgaaggcccacuccaacugcuaccccuacgacgugccggacuacgccagccugcggucccucaucgcgucguccggcacccuggaguucaacaacgagucguucaacuggaccggggucacccagaacggcacguccagcgccugcaagcgccgguccgacaacucguucuucucccgccugaacuggcucacccaccugaaguucaaguaccccgcccugaacgugaccaugcccaacaacgaggaguucgacaagcucuacaucuggggcgugcaccaccccgggaccgacaacgaccagaucucgcuguacgcccaggcguccgggcggaucacggucagcaccaagcgcucgcagcagaccgugaucccgaacaucggcucccggccccgcgugcgggacauccccucgcgcaucuccaucuacuggaccaucgucaagcccggcgacauccugcucaucaacagcacggggaaccugaucgccccgcggggcuacuucaagauccgcuccgggaaguccuccaucaugcggucggacgcccccaucggcaagugcaacuccggcugcaucacccccaacgggucgauccccaacgacaagccguuccagaacgugaaccgcaucaccuacggcgccugcccccgguacgugaagcagaacacccugaagcucgccacggggaugcgcaacguccccgagaagcagacccggggcaucuucggggcgaucgccggcuucaucgagaacggcugggaggggaugguggacggcugguacggguuccgccaccagaacuccgagggcaucgggcaggccgccgaccucaagagcacccaggccgcgaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggacguacgaccacgacguguaccgggacgaggcgcucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 8935 - RNA, 1701 nt, Artificial Sequence
  derived and/or modified CDS sequence (AUadapt) from InfluenzaA__AFH00670__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucgaacaacuccuucuucagccggcugaacuggcucacgcacuccaaguucaaguaccccgcccugaacgugaccaugcccaacaacgaggaguucgacaagcuguacaucuggggcguccuccaccccgggaccgacaacgaccagaucuuccuguacgcgcaggccucgggccgcaucaccguguccacgaagcggagccagcagaccgugaucccgaacaucgggucgcgcccccggguccgcaacauccccucccggaucagcaucuacuggaccaucgugaagcccggcgacauccugcucaucaacuccaccgggaaccugaucgccccgcgcggcuacuucaagauccggucgggcaaguccagcaucaugcgcuccgacgcccccaucgggaagugcaacucggagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccugaaguccacccaggcggccaucgaccagaucaacggcaagcugaaccgccucaucgggaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaagggcguggagcucaagucgggguacaaggacuggauccuguggaucuccuucgccaucagcugcuuccugcugugcguggcccugcucggcuucaucaugugggccugccagaaggggaacauccggugcaacaucugcaucuga

SEQ ID NO: 8936 - RNA, 1701 nt, Artificial Sequence
  derived and/or modified CDS sequence (AUadapt) from InfluenzaA__AFH00681__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgucgcugcggucccucguggccagcuccggcacgcuggaguucaacaacgagucguucaacuggaccggggucacccagaacggcaccuccagcgccugcauccgccgguccaacaacucguucuucucccgccugaacuggcucacgcaccugaaguucaaguaccccgcccugaacgugaccaugcccaacaaggagaaguucgacaagcucuacaucuggggcgugcaccaccccgggaccgacaacgaccagaucuuccuguacgcgcaggccagcgggcggaucaccgucuccacgaagcgcucgcagcagaccgugaucccgaacaucggcagccggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 8937 - RNA, 1701 nt, Artificial Sequence; identical to SEQ ID NO: 2173
  derived and/or modified CDS sequence (AUadapt) from InfluenzaA__AFH00692__HA

SEQ ID NO: 8938 - RNA, 1701 nt, Artificial Sequence
  derived and/or modified CDS sequence (AUadapt) from InfluenzaA__AFH00703__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggaagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguacagcgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcagccagcagaccgugauccccaacaucggcucccggccgcgcguccggaacauccccucgcgcaucuccaucuacuggaccaucgugaagcccggcgacauccugcucaucaacagcaccgggaaccugaucgcgccccggggcuacuucaagaugcaguccgggaaguccuccaucaugcgcucggacgccccgaucggcaagugcaacuccgagugcaucacgcccaacggcagcauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 8939 - RNA, 1701 nt, Artificial Sequence
  derived and/or modified CDS sequence (AUadapt) from InfluenzaA__AFH00714__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagagcgggggcuccuacgccugcaagcgcgggucggacaaguccuucuucagccggcugaacuggcucuacgaguccgagagcaaguaccccgugcugaacgucaccaugcccaacaacggcaacuucgacaagcuguacaucuggggcgugcaccaccccuccacggacaaggagcagaccaaccucuacgugcgcgccucggggcgggucaccgugagcaccaagcgcucccagcagacgaucaucccgaacaucggcucgcggcccugggugcgcgggcuguccagcggcaucuccaucuacuggaccaucgucaagcccggcgacauccugcucaucaacagcaacgggaaccugaucgcgccccggggcuacuucaagauccgcaccgggaaguccucgaucaugcgguccgacgccccgaucgggaccugcagcuccgagugcaucacgcccaacggcucgauccccaacgacaagcccuuccagaacgugaacaagaucaccuacggcgccugcccgaaguacgugaagcagaacacccugaagcucgccaccggcaugcgcaacguccccgagaagcagacgcgggggaucuucggcgccaucgcgggguucaucgagaacggcugggaggggaugguggacggcugguacggcuuccgccaccagaacuccgaggggaccggccaggccgccgaccucaagagcacccaggccgccaucgaccagaucaacgggaagcugaaccgggugaucgagaagaccaacgagaaguuccaccagaucgagaaggaguucuccgaggucgagggccgcauccaggaccucgagaaguacguggaggacacgaagaucgaccuguggagcuacaacgcggagcugcucguggcccuggagaaccagcacaccaucgaccugaccgacuccgagaugaacaagcuguucgagaagacccggcgccagcugcgggagaacgccgaggacauggggaacggcugcuucaagaucuaccacaagugcgacaacgccugcaucggcucgauccgcaacgggacguacgaccacgacgucuaccgcgacgaggcccugaacaaccgguuccagaucaagggcguggagcucaaguccggguacaaggacuggauccuguggaucagcuucgcgaucagcugcuuccugcucugcgucgugcugcugggcuucaucaugugggccugccagaagggcaacauccgcugcaacaucugcaucuga

SEQ ID NO: 8940 - RNA, 1701 nt, Artificial Sequence
  derived and/or modified CDS sequence (AUadapt) from InfluenzaA__AFH00725__HA
augaagaccaucaucgcccugucguacaucuucugccucaucuucgcccagaaccugcccggcaacgacaacuccaccgcgacgcugugccucgggcaccacgccgugccgaacggcacccuggucaagaccaucaccaacgaccagaucgaggugacgaacgccaccgagcuggugcagagcuccucgaccgggcgcaucugcgacagcccccaccggauccucgacggcaagaacugcacccugaucgacgcccugcucggggacccccacugcgacggcuuccagaacgagaagugggaccuguucgucgagcgcuccaaggccuucuccaacugcuaccccuacgacgugccggacuacgcgagccugcggucccucguggccucguccggcacgcuggaguucaucaacgagggguucaacuggaccggcgucacccagagcgggggcuccuacgccugcaagcgcgggucggacaacuccuucuucagccggcugaacuggcucuacgaguccgagagcaaguaccccgugcugaacgugaccaugcccaacaacggcaaguucgacaagcuguacaucuggggcguccaccaccccuccacggacaaggagcagaccaagcucuacgugcgcgccucggggcgggugaccgucagcaccaagcgcucccagcagacggugaucccgaacaucggcucgcggcccugggugcgcgggcuguccagccggaucuccaucuacuggaccaucgucaagcccggcgacauccugcucaucaacagcaccggcaaccugaucgcgccccgcggguacuucaagauccggaccggcaaguccucgaucaugcgcuccgacgccccgaucgggacgugcagcuccgagugcaucacccccaacggcucgauccccaacgacaagcccuuccagaacgugaacaagaucaccuacggggccugcccgcgguacgugaagcagaacacccugaagcucgccacgggcaugcgcaacguccccgagaagcagacccggggcaucuucggggccaucgcgggcuucaucgagaacgggugggagggcaugguggacgggugguacggcuuccgccaccagaacuccgagggcaccgggcaggccgccgaccucaagagcacccaggccgccaucgaccagaucaacggcaagcugaaccgggugaucgagaagacgaacgagaaguuccaccagaucgagaaggaguucuccgaggucgaggggcgcauccaggaccucgagaaguacguggaggacaccaagaucgaccuguggagcuacaacgcggagcugcucguggcccuggagaaccagcacaccaucgaccugaccgacuccgagaugaacaagcuguucgagaagacgcggaagcagcugcgcgagaacgccgaggacaugggcaacgggugcuucaagaucuaccacaagugcgacaacgccugcaucggcucgauccgcaacggcaccuacgaccacgacgucuaccgggacgaggcccugaacaaccgcuuccagaucaaggggguggagcucaaguccggcuacaaggacuggauccuguggaucagcuucgcgaucagcugcuuccugcucugcgucgugcugcugggguucaucaugugggccugccagaagggcaacauccggugcaacaucugcaucuga

SEQ ID NO: 8941 - RNA, 1701 nt, Artificial Sequence; identical to SEQ ID NO: 7311
  derived and/or modified CDS sequence (AUadapt) from InfluenzaA__AFH00736__HA

SEQ ID NO: 8942 - RNA, 1701 nt, Artificial Sequence
  derived and/or modified CDS sequence (AUadapt) from InfluenzaA__AFH00747__HA
augaagaccaucaucgcccugucguacaucuucugccucguguucgcccagaagcugcccggcaacgacaacuccaccgcgacgcugugccucgggcacuacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccagcuccggcacgcuggaguucaucaacgaggacuucaacuggaccggggugacccagucgggcggguccuacgccugcaagcgcggcagcgugaaguccuucuucucgcggcugaacuggcuccacgaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugagcaccaagcggucgcagcagacggugaucccgaacaucgggucccgccccuggguccggggccugagcucccgcaucucgaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacucggagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacucggagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 8943 - RNA, 1701 nt, Artificial Sequence
  derived and/or modified CDS sequence (AUadapt) from InfluenzaA__AFH00758__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagagcggcgaguccuacgccugcaagcgcgggucggugaaguccuucuucagccggcucaacuggcugcacgaguccgaguacaaguaccccgcgcugaacgucaccaugcccaacaacggcaaguucgacaagcucuacaucuggggcgugcaccaccccucgaccgaccgcgagcagacgaagcuguacgugcgggccuccgggcgcgucaccgugagcaccaagcggucgcagcagaccgugaucccgaacaucggcucccgccccuggguccgggggcugagcucccgcaucucgaucuacuggacgaucgugaagcccggcgacauccuccugaucaacuccaccgggaaccugaucgcgccccggggcuacuucaagauccgcaccggcaagagcuccaucaugcggucggacgccccgaucgggaccugcuccagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacucggaggggaccggccaggccgccgaccugaaguccacccaggcggccaucgaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacucggagaugaacaagcuguucgagaagacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggcuacaaggacuggauccucuggaucuccuucgccaucagcugcuuccugcugugcgucgugcuccugggguucaucaugugggccugccagaagggcaacauccggugcaacaucugcaucuga

SEQ ID NO: 8944 - RNA, 1701 nt, Artificial Sequence
  derived and/or modified CDS sequence (AUadapt) from InfluenzaA__AFH00769__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagagcggcgaguccuacacgugcaagcgcgggucggugaaguccuucuucagccggcucaacuggcugcacgaguccgaguacaaguaccccgcccugaacgucaccaugcccaacaacgacaaguucgacaagcucuacaucuggggcgugcaccaccccucgaccgaccgcgagcagaccucccuguacauccgggcgagcgggcgcgugaccgucucgaccaagcggucccagcagacggugaucccgaacaucggcagccgccccugggugcggggccuguccucgcgcaucuccaucuacuggaccaucgucaagcccggggacauccuccugaucaacagcaccggcaaccugaucgcgccccggggguacuucaagauccgcaccggcaaguccucgaucaugcgguccgacgccccgaucggcacgugcagcuccgagugcaucacccccaacgggucgauccccaacgacaagcccuuccagaacgugaaccgcaucaccuacggcgccugcccgcgguacgugaagcagaacacccucaagcuggccacggggaugcgcaacguccccgagaagcagacccggggcaucuucggggccaucgccggcuucaucgagaacggcugggaggggaugguggacggcugguacggguuccgccaccagaacuccgagggcaccgggcaggccgccgaccugaaguccacccaggccgcgaucgaccagaucaacggcaagcucaaccggcugaucgagaagacgaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacauggggaacggcugcuucaagaucuaccacaagugcgacaacgccugcaucgggucgauccgcaacggcaccuacgaccacgacguguaccgggacgaggcgcugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 8945 - RNA, 1701 nt, Artificial Sequence
  derived and/or modified CDS sequence (AUadapt) from InfluenzaA__AFH00780__HA
augcgcgccaucaucgcccugucguacauccucugccugguguucgcgcagaagcugcccggcaacgacaacuccaccgccacccucugccuggggcaccacgccgucccgaacggcacgcuggugaagaccaucaccaacgaccagaucgaggugaccaacgccacggagcucguccagagcuccucgaccgggcggaucugcgacagcccccaccgcauccuggacggcaagaacugcacccugaucgacgcccuccugggggacccccacugcgacggcuuccagaacaaggagugggaccuguucguggagcggucgaaggcguacuccgacugcuaccccuacgacgugccggacuacgccagccuccgcucccuggucgccucguccggcacccuggaguucacgaacgagggguucaacuggaccggcguggcccaggacgggaccagcuacgcgugcaagcggggcuccgugaaguccuucuucucccgccucaacuggcugcacaagcuggaguacaaguaccccgcccucaacgucaccaugcccaacaacgacaaguucgacaagcuguacaucuggggcgugcaccaccccucgacggacuccgaccagaccagccuguacgugcaggccuccgggcgggucaccgugucgaccaagcgcagccagcagacggugaucccgaacaucggcucccggcccuggguccgcggggugucgucccggaucagcaucuacuggaccaucgugaagcccggcgacauccuccugaucaacuccaccgggaaccugaucgcgccccgcggcuacuucaagauccggucgggcaaguccagcaucaugcgcuccgacgccccgaucgggaacugcaacucggagugcaucacccccaacggcuccauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggcuucaucgagaacgggugggagggcauggucgacgggugguacggcuuccggcaccagaacagcgaggggacgggccaggccgcggaccugaaguccacccaggccgccaucaaccagaucaacggcaagcucaaccgccugaucgagaagaccaacgagaaguuccaccagaucgagaaggaguucucggagguggaggggcggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagucgggcuacaaggacuggauccuguggaucuccuucgccaucagcugcuuccugcugugcguggugcuccugggguucaucaugugggccugccagaagggcaacauccggugcaacaucugcaucuga

SEQ ID NO: 8946 - RNA, 1701 nt, Artificial Sequence
  derived and/or modified CDS sequence (AUadapt) from InfluenzaA__AFH00791__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggucguccaccggccgcaucugcgacagcccccaccagauccuggacgggaagaacugcacccugaucgacgcccuccugggcgacccccacugcgacggcuuccagaacaaggagugggaccuguucguggagcgguccacggccuacucgaacugcuaccccuacgacgugccggacuacgcgucccuccgcagccuggucgccuccucggggacccuggaguucaccaaggagggcuucaacuggaccgggguggcccaggacggcacguccuacacgugcaagcgggggagcgugaaguccuucuucucgcgccucaacuggcugcacaagcuggaguacaaguaccccgcccucaacgucaccaugcccaacaacgacaaguucgacaagcuguacaucuggggcgugcaccaccccuccaccgacagcgaccagaccucccuguacgugcaggcgucgggccgggucaccguguccaccaagcgcagccagcagaccgugaucccgaacaucgggucgcggcccuggguccgcggcguguccagccggaucuccaucuacuggacgaucgugaagcccggggacauccuccugaucaacucgaccggcaaccugaucgcgccccgcggcuacuucaagauccgguccggcaagagcuccaucaugcgcucggacgccccgaucgacaacugcaacuccgagugcaucacccccaacgggagcauccccaacgacaagcccuuccagaacgucaaccggaucaccuacggggccugcccgcgcuacgugaagcagaacacgcucaagcuggccaccggcaugcggaacgugcccgagaagcagacccgcgggaucuucggcgccaucgccggcuucaucgagaacgggugggagggcauggucgacgggugguacggcuuccggcaccagaacuccgaggggaccggccaggccgccgaccucaagucgacgcaggccgcgaucaaccagaucaacggcaagcugaaccgccugaucgagaagaccaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacaccaucgaccugacggacuccgagaugaacaagcuguucgagcgcacccggaagcagcuccgcgagaacgccgaggacaugggcaacgggugcuucaagaucuaccacaagugcgacaacgccugcaucggcucgauccgcaacgggaccuacgaccacgacguguaccgggacgaggcgcugaacaaccgcuuccagaucaagggcgucgagcugaaguccggcuacaaggacuggauccucuggaucagcuucgccaucuccugcuuccugcugugcguggugcuccugggguucaucaugugggccugccagaagggcaacauccggugcaacaucugcaucuga

SEQ ID NO: 8947 - RNA, 1701 nt, Artificial Sequence; identical to SEQ ID NO: 1587
  derived and/or modified CDS sequence (AUadapt) from InfluenzaA__AFH00802__HA

SEQ ID NO: 8948 - RNA, 1701 nt, Artificial Sequence
  derived and/or modified CDS sequence (AUadapt) from InfluenzaA__AFH00813__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccgggacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 8949 - RNA, 1701 nt, Artificial Sequence
  derived and/or modified CDS sequence (AUadapt) from InfluenzaA__AFH00824__HA
augaagaccaucaucgcccugucguacauccuccgccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaucggggagaucugcaacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccucggggcgcaucaccguguccaccaagcggagccagcaggccgugaucccgaacaucggcucgcgcccccggauccgcgacauccccucccggaucagcaucuacuggacgaucgucaagcccggcgacauccugcucaucaacuccaccgggaaccugaucgccccgcgcggcuacuucaagauccggucggggaaguccagcaucaugcgcuccgacgcccccaucggcaagugcaacucggagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 8950 - RNA, 1701 nt, Artificial Sequence
  derived and/or modified CDS sequence (AUadapt) from InfluenzaA__AFH01407__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcaacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacaucuccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacgucuaccgggacgaggcccucaacaaccgcuuccagaucaaggggguggagcugaaguccggcuacaaggacuggauccuguggaucucguucgccaucagcugcuuccuccugugcguggcccugcucggcuucaucaugugggccugccagaaggggaacauccggugcaacaucugcaucuga

SEQ ID NO: 8951 - RNA, 1701 nt, Artificial Sequence
  derived and/or modified CDS sequence (AUadapt) from InfluenzaA__AFH34940__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacgggguccgagaugaacaagcuguucgagaagaccaagaagcagcugcgcgagaacgccgaggacaugggcaacgggugcuucaagaucuaccacaagugcgacaacgcgugcaucggcucgauccgcaacgggaccuacaaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 8952 - RNA, 1701 nt, Artificial Sequence
  derived and/or modified CDS sequence (AUadapt) from InfluenzaA__AFH34961__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccgccucgggcacgcuggaguucaacaacgaguccuucaacuggaccggggugacccagaacggcaccagcuccgccugcauccgccggucgaacuccagcuucuucucccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccagucguccgggcggaucaccgugagcacgaagcgcucgcagcaggccgugaucccgaacaucggcucccggccccgcauccggaacauccccagccgcaucuccaucuacuggaccaucgucaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucacguacggggcgugcccccgguacgugaagcaguccacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacaaccacgacguguaccgggacgaggcccucaacaaccgcuuccagaucaagggggucgagcucaagucgggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 8953 - RNA, 1701 nt, Artificial Sequence
  derived and/or modified CDS sequence (AUadapt) from InfluenzaA__AFH34968__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccgccucgggcacgcuggaguucaacaacgaguccuucaacuggaccggggugacccagaacggcaccagcuccgccugcauccgccggucgaacuccagcuucuucucccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccagucguccgggcggaucaccgugagcacgaagcgcucgcagcaggccgugaucccgaacaucggcucccggccccgcauccgggacauccccagccgcaucuccaucuacuggaccaucgucaagcccggcgacauccugcucaucaacucgaccgggaaccugaucgccccgcggggcuacuucaagauccgcuccgggaaguccuccaucaugcggagcgacgcccccaucggcaagugcaacuccgcgugcaucacccccaacggcucgauccccaacgacaagccguuccagaacgugaaccgcaucacguacggggccugcccccgguacgugaagcaguccacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacaaccacgacguguaccgggacgaggcccucaacaaccgcuuccagaucaagggggucgagcucaagucgggcuacaaggacuggauccuguggaucuccuucgccaucagcugcuuccugcugugcguggcgcugcucggcuucaucaugugggccugccagaaggggaacauccggugcaacaucugcaucuga

SEQ ID NO: 8954 - RNA, 1701 nt, Artificial Sequence; identical to SEQ ID NO: 138
  derived and/or modified CDS sequence (AUadapt) from InfluenzaA__AFH34975__HA

SEQ ID NO: 8955 - RNA, 1701 nt, Artificial Sequence; identical to SEQ ID NO: 3656
  derived and/or modified CDS sequence (AUadapt) from InfluenzaA__AFH74464__HA

SEQ ID NO: 8956 - RNA, 1701 nt, Artificial Sequence; identical to SEQ ID NO: 116
  derived and/or modified CDS sequence (AUadapt) from InfluenzaA__AFH74465__HA

SEQ ID NO: 8957 - RNA, 1701 nt, Artificial Sequence; identical to SEQ ID NO: 3675
  derived and/or modified CDS sequence (AUadapt) from InfluenzaA__AFH74477__HA

SEQ ID NO: 8958 - RNA, 1701 nt, Artificial Sequence
  derived and/or modified CDS sequence (AUadapt) from InfluenzaA__AFH74488__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacaacccccaccagauccucgacggcaagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaagaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcagaccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgcgagaacgccgaggacauggggaacggcugcuucaagaucuaccacaagugcgacaacgcgugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 8959 - RNA, 1701 nt, Artificial Sequence; identical to SEQ ID NO: 3656
  derived and/or modified CDS sequence (AUadapt) from InfluenzaA__AFH74499__HA

SEQ ID NO: 8960 - RNA, 1701 nt, Artificial Sequence; identical to SEQ ID NO: 3858
  derived and/or modified CDS sequence (AUadapt) from InfluenzaA__AFH74510__HA

SEQ ID NO: 8961 - RNA, 1701 nt, Artificial Sequence
  derived and/or modified CDS sequence (AUadapt) from InfluenzaA__AFH74521__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcaacucgccccaccagauccuggacggcgagaacugcacccucaucgacgcccugcugggggacccccagugcgacggcuuccagaacaagaagugggaccucuucguggagcgcucgaaggccuacuccaacugcuaccccuacgacgugccggacuacgcgagccugcggucccuggucgccucguccggcacgcucgaguucaacaacgagucguucaacuggaccggggugacccagaacggcaccuccagcgccugcauccgccgguccaacaacucguucuucucccgccugaacuggcugacgcacagcaaguccaaguaccccgcccucaacgugaccaugcccaacaacgagcaguucgacaagcuguacaucuggggcguccaccaccccgggaccgacaacgaccagaucuuccuguacgcgcaggccucggggcggaucaccgugucgacgaagcgcucccagcagaccgugaucccgaacaucggcagccggccccgcauccgggacauccccucccgcaucucgaucuacuggaccaucgucaagcccggcgacauccuccugaucaacuccaccgggaaccugaucgccccgcggggcuacuucaagauccgcucggggaaguccagcaucaugaaguccgacgcccccaucggcaagugcaacucggagugcaucacgcccaacggcuccauccccaacgacaagccguuccagaacgugaaccggaucaccuacggggccugcccccgcuacgugaagcagaacacccucaagcuggcgaccggcaugcggaacguccccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcucaaccggcugaucggcaagaccaacgagaaguuccaccagaucgagaaggaguucagcgagguggagggccgcauccaggaccuggagaaguacgucgaggacaccaagguggaccucugguccuacaacgccgagcugcugguggcccucgagaaccagcacacgaucgaccugaccgacucggagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 8962 - RNA, 1701 nt, Artificial Sequence; identical to SEQ ID NO: 7233
  derived and/or modified CDS sequence (AUadapt) from InfluenzaA__AFH74532__HA

SEQ ID NO: 8963 - RNA, 1701 nt, Artificial Sequence; identical to SEQ ID NO: 3858
  derived and/or modified CDS sequence (AUadapt) from InfluenzaA__AFH74543__HA

SEQ ID NO: 8964 - RNA, 1701 nt, Artificial Sequence; identical to SEQ ID NO: 3858
  derived and/or modified CDS sequence (AUadapt) from InfluenzaA__AFH74554__HA

SEQ ID NO: 8965 - RNA, 1701 nt, Artificial Sequence; identical to SEQ ID NO: 3858
  derived and/or modified CDS sequence (AUadapt) from InfluenzaA__AFH74565__HA

SEQ ID NO: 8966 - RNA, 1701 nt, Artificial Sequence; identical to SEQ ID NO: 3858
  derived and/or modified CDS sequence (AUadapt) from InfluenzaA__AFH74576__HA

SEQ ID NO: 8967 - RNA, 1701 nt, Artificial Sequence; identical to SEQ ID NO: 3858
  derived and/or modified CDS sequence (AUadapt) from InfluenzaA__AFH74587__HA

SEQ ID NO: 8968 - RNA, 1701 nt, Artificial Sequence
  derived and/or modified CDS sequence (AUadapt) from InfluenzaA__AFH74598__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgagaucugcgacucgccccaccagauccucgacgggaagaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggcgugacccagaacgggaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcucgcagcagaccgccaucccgaacaucgggucgcggccccgcgugcggaacauccccucccgcaucagcaucuacuggaccaucgucaagcccggcgacauccugcucaucaacuccaccggcaaccugaucgccccgcggggguacuucaagauccgcucgggcaaguccagcaucaugcgguccgacgcccccaucgggaagugcaacucggagugcaucacgcccaacggcuccauccccaacgacaagccguuccagaacgugaaccgcaucaccuacggcgcgugcccccgguacgugaagcagaacacccugaagcucgccaccgggaugcgcaacguccccgagaagcagacgcggggcaucuucggggccaucgccggcuucaucgagaacgggugggagggcaugguggacggcugguacggguuccgccaccagaacucggagggccgggggcaggccgcggaccugaaguccacccaggccgccaucgaccagaucaacggcaagcugaaccgccucaucgggaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggcgugccagaagggcaacauccggugcaacaucugcaucuga

SEQ ID NO: 8969 - RNA, 1701 nt, Artificial Sequence; identical to SEQ ID NO: 3656
  derived and/or modified CDS sequence (AUadapt) from InfluenzaA__AFH74609__HA

SEQ ID NO: 8970 - RNA, 1701 nt, Artificial Sequence; identical to SEQ ID NO: 3858
  derived and/or modified CDS sequence (AUadapt) from InfluenzaA__AFH74620__HA

SEQ ID NO: 8971 - RNA, 1701 nt, Artificial Sequence
  derived and/or modified CDS sequence (AUadapt) from InfluenzaA__AFH74631__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaccaacugcacgcugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggaccggggugacccagaacggcacguccucggccugcauccgccgguccaagaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucacgguguccaccaagcgcucgcagcagaccgccaucccgaacaucggcucgcggccccgcgugcggaacauccccucccgcaucagcaucuacuggaccaucgucaagcccggcgacauccugcucaucaacuccacggggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucaccuacggggcgugcccccgguacgugaagcagaacacccugaagcucgccacgggcaugcgcaacguccccgagaagcagacccgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 8972 - RNA, 1701 nt, Artificial Sequence; identical to SEQ ID NO: 3656
  derived and/or modified CDS sequence (AUadapt) from InfluenzaA__AFH74642__HA

SEQ ID NO: 8973 - RNA, 1701 nt, Artificial Sequence; identical to SEQ ID NO: 3656
  derived and/or modified CDS sequence (AUadapt) from InfluenzaA__AFH74653__HA

SEQ ID NO: 8974 - RNA, 1701 nt, Artificial Sequence; identical to SEQ ID NO: 3656
  derived and/or modified CDS sequence (AUadapt) from InfluenzaA__AFH74664__HA

SEQ ID NO: 8975 - RNA, 1701 nt, Artificial Sequence; identical to SEQ ID NO: 3656
  derived and/or modified CDS sequence (AUadapt) from InfluenzaA__AFH74675__HA

SEQ ID NO: 8976 - RNA, 1701 nt, Artificial Sequence; identical to SEQ ID NO: 8404
  derived and/or modified CDS sequence (AUadapt) from InfluenzaA__AFH74686__HA

SEQ ID NO: 8977 - RNA, 1701 nt, Artificial Sequence; identical to SEQ ID NO: 8404
  derived and/or modified CDS sequence (AUadapt) from InfluenzaA__AFH74697__HA

SEQ ID NO: 8978 - RNA, 1701 nt, Artificial Sequence; identical to SEQ ID NO: 3858
  derived and/or modified CDS sequence (AUadapt) from InfluenzaA__AFH74708__HA

SEQ ID NO: 8979 - RNA, 1701 nt, Artificial Sequence; identical to SEQ ID NO: 3858
  derived and/or modified CDS sequence (AUadapt) from InfluenzaA__AFH74719__HA

SEQ ID NO: 8980 - RNA, 1701 nt, Artificial Sequence; identical to SEQ ID NO: 3858
  derived and/or modified CDS sequence (AUadapt) from InfluenzaA__AFH74730__HA

SEQ ID NO: 8981 - RNA, 1701 nt, Artificial Sequence
  derived and/or modified CDS sequence (AUadapt) from InfluenzaA__AFH74741__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcaagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcucccagcagaccgccaucccgaacaucggcucgcggccccgcgugcggaacauccccagccgcaucuccaucuacuggaccaucgucaagcccggcgacauccugcucaucaacucgaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccucaagucgacccaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 8982 - RNA, 1701 nt, Artificial Sequence; identical to SEQ ID NO: 3858
  derived and/or modified CDS sequence (AUadapt) from InfluenzaA__AFH74752__HA

SEQ ID NO: 8983 - RNA, 1701 nt, Artificial Sequence; identical to SEQ ID NO: 3858
  derived and/or modified CDS sequence (AUadapt) from InfluenzaA__AFH74763__HA

SEQ ID NO: 8984 - RNA, 1701 nt, Artificial Sequence; identical to SEQ ID NO: 3858
  derived and/or modified CDS sequence (AUadapt) from InfluenzaA__AFH74774__HA

SEQ ID NO: 8985 - RNA, 1701 nt, Artificial Sequence; identical to SEQ ID NO: 7233
  derived and/or modified CDS sequence (AUadapt) from InfluenzaA__AFH74785__HA

SEQ ID NO: 8986 - RNA, 1701 nt, Artificial Sequence; identical to SEQ ID NO: 3858
  derived and/or modified CDS sequence (AUadapt) from InfluenzaA__AFH74796__HA

SEQ ID NO: 8987 - RNA, 1701 nt, Artificial Sequence; identical to SEQ ID NO: 8414
  derived and/or modified CDS sequence (AUadapt) from InfluenzaA__AFH74807__HA

SEQ ID NO: 8988 - RNA, 1701 nt, Artificial Sequence; identical to SEQ ID NO: 8414
  derived and/or modified CDS sequence (AUadapt) from InfluenzaA__AFH74818__HA

SEQ ID NO: 8989 - RNA, 1701 nt, Artificial Sequence; identical to SEQ ID NO: 8414
  derived and/or modified CDS sequence (AUadapt) from InfluenzaA__AFH74829__HA

SEQ ID NO: 8990 - RNA, 1701 nt, Artificial Sequence; identical to SEQ ID NO: 8414
  derived and/or modified CDS sequence (AUadapt) from InfluenzaA__AFH74840__HA

SEQ ID NO: 8991 - RNA, 1701 nt, Artificial Sequence
  derived and/or modified CDS sequence (AUadapt) from InfluenzaA__AFH74851__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacggcaacugcuaccccuacgacgugccggacuacgcgucccugcggagccucgucgccuccucggggacgcuggaguucaacaacgaguccuucaacuggaccggcgugacccagaacgggaccucguccgccugcauccgccggagcaagaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugucgacgaagcgcucccagcagaccgccaucccgaacaucggcagccggccccgcgugcggaacauccccucgcgcaucuccaucuacuggaccaucgucaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgcgugcccccgguacgugaagcagaacacccugcgccucgccaccgggaugcggaacguccccgagaagcagacgcgcggcaucuucggggccaucgccggcuucaucgagaacggcugggaggggaugguggacggcugguacggguuccggcaccagaacuccgagggccgcgggcaggccgcggaccugaaguccacccaggccgccaucgaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacaugggcaacgggugcuucaagaucuaccacaagugcgacaacgccugcaucggcucgauccggaacgggaccuacgaccacgacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggcgugccagaagggcaacauccgcugcaacaucugcaucuga

SEQ ID NO: 8992 - RNA, 1701 nt, Artificial Sequence; identical to SEQ ID NO: 8417
  derived and/or modified CDS sequence (AUadapt) from InfluenzaA__AFH74862__HA

SEQ ID NO: 8993 - RNA, 1701 nt, Artificial Sequence; identical to SEQ ID NO: 8417
  derived and/or modified CDS sequence (AUadapt) from InfluenzaA__AFH74873__HA

SEQ ID NO: 8994 - RNA, 1701 nt, Artificial Sequence; identical to SEQ ID NO: 3858
  derived and/or modified CDS sequence (AUadapt) from InfluenzaA__AFH74884__HA

SEQ ID NO: 8995 - RNA, 1701 nt, Artificial Sequence; identical to SEQ ID NO: 3858
  derived and/or modified CDS sequence (AUadapt) from InfluenzaA__AFH74895__HA

SEQ ID NO: 8996 - RNA, 1701 nt, Artificial Sequence; identical to SEQ ID NO: 3858
  derived and/or modified CDS sequence (AUadapt) from InfluenzaA__AFH74906__HA

SEQ ID NO: 8997 - RNA, 1701 nt, Artificial Sequence; identical to SEQ ID NO: 3656
  derived and/or modified CDS sequence (AUadapt) from InfluenzaA__AFH74917__HA

SEQ ID NO: 8998 - RNA, 1701 nt, Artificial Sequence; identical to SEQ ID NO: 3858
  derived and/or modified CDS sequence (AUadapt) from InfluenzaA__AFH74928__HA

SEQ ID NO: 8999 - RNA, 1701 nt, Artificial Sequence; identical to SEQ ID NO: 3858
  derived and/or modified CDS sequence (AUadapt) from InfluenzaA__AFH74939__HA

SEQ ID NO: 9000 - RNA, 1701 nt, Artificial Sequence
  derived and/or modified CDS sequence (AUadapt) from InfluenzaA__AFH74950__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacggcaacugcuaccccuacgacgugccggacuacgcgucccugcggagccucgucgccuccucggggacgcuggaguucaacaacgaguccuucaacuggaccggcgugacccagaacgggaccucguccgccugcauccgccggagcaagaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugucgacgaagcgcucccagcagaccgccaucccgaacaucggcagccggccccgcgugcggaacauccccucgcgcaucuccaucuacuggaccaucgucaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgcgugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggccgggggcaggccgcggaccugaaguccacccaggccgccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacaugggcaacgggugcuucaagaucuaccacaagugcgacaacgccugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 9001 - RNA, 1701 nt, Artificial Sequence; identical to SEQ ID NO: 8417
  derived and/or modified CDS sequence (AUadapt) from InfluenzaA__AFH74961__HA

SEQ ID NO: 9002 - RNA, 1701 nt, Artificial Sequence; identical to SEQ ID NO: 3858
  derived and/or modified CDS sequence (AUadapt) from InfluenzaA__AFH75388__HA

SEQ ID NO: 9003 - RNA, 1701 nt, Artificial Sequence
  derived and/or modified CDS sequence (AUadapt) from InfluenzaA__AFH97140__HA
augaaggccauccuggugguccuccuguacaucuucgccaccgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 9004 - RNA, 1701 nt, Artificial Sequence
  derived and/or modified CDS sequence (AUadapt) from InfluenzaA__AFJ05142__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaagugggaccucuucguggagcgcucgaaggccuacuccaacugcuaccccuacgacgugccggacuacgcgagccugcggucccuggucgccucguccggcacgcucgaguucaacaacgagugcuucaacuggaccggggugacccagaacggcaccagcuccgccugcauccgccggucgaacuccagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcagagcuccgggcggaucaccgugucgacgaagcgcagccagcaggccgugaucccgaacaucggcucccggccccgcauccggaacauccccucgcgcaucuccaucuacuggaccaucgucaagcccggcgacauccugcugaucaacagcaccgggaaccucaucgccccgcggggcuacuucaagauccgcuccgggaaguccuccaucaugcggucggacgcccccaucggcaagugcaacuccggcugcaucacccccaacgggagcauccccaacgacaagccguuccagaacgugaaccgcaucacguacggcgccugcccccgguacgugaagcaguccacccugaagcuggcgaccgggaugcgcaacguccccgagaagcagacccggggcaucuucggggccaucgccggcuucaucgagaacggcugggaggggaugguggacggcugguacggguuccgccaccagaacucggagggccgggggcaggccgccgaccucaaguccacgcaggcggccaucgaccagaucaacggcaagcugaaccgccugaucggcaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacaugggcaacgggugcuucaagaucuaccacaagugcgacaacgcgugcaucggcuccauccgcaacgggaccuacaaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 9005 - RNA, 1701 nt, Artificial Sequence
  derived and/or modified CDS sequence (AUadapt) from InfluenzaA__AFJ05144__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgucaagcagucgacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 9006 - RNA, 1701 nt, Artificial Sequence
  derived and/or modified CDS sequence (AUadapt) from InfluenzaA__AFJ11706__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgcuccagcaacaacuccuucuucucgcggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcgcaucaccgugagcacgaagcggucgcagcaggccgugaucccgaacaucggcucccgcccccggguccgcaacauccccagccggaucuccaucuacuggaccaucgugaagcccggcgacauccugcucaucaacucgaccgggaaccugaucgccccgcgcggcuacuucaagauccgguccgggaaguccuccaucaugcgcagcgacgcccccaucggcaagugcaacuccgagugcaucacccccaacggcucgauccccaacgacaagccguuccagaacgugaaccggaucacguacggggcgugcccccgcuacgucaagcaguccacccugaagcucgccaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgcggaccugaaguccacgcaggccgccaucgaccagaucaacgggaagcugaaccggcucaucggcaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaccaucuaccacaagugcgacaacgccugcaucggguccauccgcaacggcaccuacgaccacaacgucuaccgcgacgaggcccucaacaaccgguuccagaucaaggggguggagcucaagucgggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 9007 - RNA, 1701 nt, Artificial Sequence; identical to SEQ ID NO: 7227
  derived and/or modified CDS sequence (AUadapt) from InfluenzaA__AFJ11728__HA

SEQ ID NO: 9008 - RNA, 1701 nt, Artificial Sequence
  derived and/or modified CDS sequence (AUadapt) from InfluenzaA__AFJ19842__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacgacguguaccgcgacgaggcccucaacaaccgguuccagaucaaggggaucgagcugaaguccggcuacaaggacuggauccuguggaucagcuucgccaucuccugcuuccuccugugcgucgcgcugcucggcuucaucaugugggccugccagaaggggaacauccgcugcaacaucugcaucuga

SEQ ID NO: 9009 - RNA, 1701 nt, Artificial Sequence; identical to SEQ ID NO: 8606
  derived and/or modified CDS sequence (AUadapt) from InfluenzaA__AFJ20171__HA

SEQ ID NO: 9010 - RNA, 1701 nt, Artificial Sequence; identical to SEQ ID NO: 7227
  derived and/or modified CDS sequence (AUadapt) from InfluenzaA__AFJ20182__HA

SEQ ID NO: 9011 - RNA, 1701 nt, Artificial Sequence
  derived and/or modified CDS sequence (AUadapt) from InfluenzaA__AFJ74386__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcgugauguccagccacuacucccgccgguucaccccggagaucgccaagcgccccaagguccgggaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgagugcgacgccaagugccagaccccgcagggggccaucaacagcucccugcccuuccagaacgugcaccccgugaccaucggcgagugccccaaguacguccgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucgacggcaucacgaacaaggugaacagcgucaucgagaagaugaacacccaguucaccgccguggggaaggaguucaacaagcuggagcgccggauggagaaccucaacaagaagguggacgacggcuuccuggacaucuggaccuacaacgcggagcugcucguccugcuggagaacgagcgcacgcucgacuuccacgacucgaacgugaagaaccuguacgagaaggucaagaaccagcugaagaacaacgccaaggagaucgggaacggcugcuucgaguucuaccacaagugcaacaacgagugcauggaguccgugaagaacgggaccuacgacuaccccaaguacagcggcgaguccaagcucaaccgggagaagaucgacggcgugaagcuggagagcaugggggucuaccagauccuggccaucuacucgaccguggccuccagccucgugcugcuggucucccucggcgccaucagcuucuggaugugcuccaacgggagccugcagugccgcaucugcaucuga

SEQ ID NO: 9012 - RNA, 1701 nt, Artificial Sequence
  derived and/or modified CDS sequence (AUadapt) from InfluenzaA__AFJ74407__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccuccugaucaacuccaccgggaaccugaucgcgccccggggcuacuucaagauccgcucgggcaaguccagcaucaugcgguccgacgccccgaucgggaacugcucguccgagugcaucacgcccaacggcagcauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacuccgaggggaccggccaggccgccgaccucaagucgacccaggcggccaucaaccagaucaacggcaagcugaaccggcugaucgagaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggacguacgaccacgacguguaccgcgacgaggcccugaacaaccgguuccagaucaagggcgucgagcugaaguccggcuacaaggacuggauccucuggaucagcuucgccaucagcugcuuccugcugugcguggugcuccugggguucaucaugugggccugccagaagggcaacauccgcugcaacaucugcaucuga

SEQ ID NO: 9013 - RNA, 1701 nt, Artificial Sequence
  derived and/or modified CDS sequence (AUadapt) from InfluenzaA__AFJ74418__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaucaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucagcaucuacuggacgaucgucaagcccggcgacauccuccugaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucucggagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 9014 - RNA, 1701 nt, Artificial Sequence
  derived and/or modified CDS sequence (AUadapt) from InfluenzaA__AFJ74437__HA
augaagaccaucaucgcccugucguacauccucugcaagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccagauccucgacggcgagaacugcacccugaucgacgcccugcucggggacccccacugcgacggcuuccagaacaaggagugggaccuguucguggagcggagcaaggccuacuccaacugcuaccccuacgacgugccggacuacgcgucgcugcgcucccucgucgccagcuccggcacgcuggaguucaacaacgagucguucaacuggaccgggguggcccagaacggcaccuccagcgccugcaagcggcgcuccaucaagucguucuucucccggcugaacuggcuccaccagcugaaguacaaguaccccgcgcugaacgugaccaugcccaacaacgagaaguucgacaagcucuacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccugcucaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcugaagcucgccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcugaaccggcucaucgagaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcgugguccugcucggcuucaucaugugggccugccagaagggcaacauccggugcaacaucugcaucuga

SEQ ID NO: 9015 - RNA, 1701 nt, Artificial Sequence
  derived and/or modified CDS sequence (AUadapt) from InfluenzaA__AFJ74448__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccucgggggcccccacugcgacggcuuccagaacaaggagugggaccuguucguggagcggagcaaggccuacuccaacugcuaccccuacgacgugccggacuacgcgucgcugcgcucccuggucgccagcuccgggacgcuggaguucaacaacgagucguucaacuggaccggcguggcccagaacgggaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucggcucccgccccugggugcggggcgugagcucccgcaucucgaucuacuggacgaucgucaagcccggggacauccuccugaucaacuccaccggcaaccugaucgcgccccggggguacuucaagauccgcagcggcaaguccucgaucaugcgguccgacgccccgaucggcaagugcaacagcgagugcaucacccccaacggguccauccccaacgacaagcccuuccagaacgugaaccgcaucaccuacggcgccugcccgcgguacgugaagcagaacacgcucaagcuggccaccgggaugcgcaacguccccgagaagcagacccggggcaucuucggggccaucgccggcuucaucgagaacggcugggaggggaugguggacggcugguacggguuccgccaccagaacucggagggcaccgggcaggccgcggaccugaaguccacgcaggccgccaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 9016 - RNA, 1701 nt, Artificial Sequence
  derived and/or modified CDS sequence (AUadapt) from InfluenzaA__AFJ74459__HA
auggaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgugagcuccuucgagcgcuucgagaucuucccgaaggagucguccuggcccaaccacaccgucaccaagggggugaccgccagcugcucccacaacggcaagagcuccuucuacaagaaccugcucuggcugacggagaagaacgggcuguaccccaaccucucgaaguccuacgugaacaacaaggagaaggagguccuggugcuguggggcgugcaccaccccagcaacaucggggaccagcgggccaucuaccacaccgagaacgcguacgucagcgugguguccagccacuacucccgccgguucaccccggagaucgccaagcgccccaagguccggaaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgagugcgacgccaagugccagaccccgcagggggccaucaacagcucccugcccuuccagaacgugcaccccgugaccaucggcgagugccccaaguacguccgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucaacggcaucacgaacaaggugaacagcaucaucgagaagaugaacacccaguucaccgccgucgggaaggaguucaacaagcuggagcgccggauggagaaccucaacaagaagguggacgacggcuuccuggacaucuggaccuacaacgcggagcugcucgugcugcuggagaacgagcgcacgcucgacuuccacgacucgaacgucaagaaccuguacgagaaggugaagaaccagcugaagaacaacgccaaggagaucgggaacggcugcuucgaguucuaccacaagugcaacaacgagugcauggaguccgucaagaacgggaccuacgacuaccccaaguacagcaaggaguccaagcucaaccgggagaagaucgacggcgugaagcuggagagcaugggcguguaccagauccuggccaucuacucgaccgucgccuccagccucgugcugcuggugucccucggggccaucagcuucuggaugugcuccaacggcagccugcagugccgcaucugcaucuga

SEQ ID NO: 9017 - RNA, 1701 nt, Artificial Sequence
  derived and/or modified CDS sequence (AUadapt) from InfluenzaA__AFJ74470__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccuacgccugcaagcgccggagcgugaaguccuucuucucgcgccucaacuggcugcacaagcuggaguacaaguaccccgcgcucaacgucaccaugcccaacaacgacaaguucgacaagcuguacaucuggggcgugcaccaccccuccacggacagcgaccagaucucccuguacgcccagaccucggggcgggugaccgucagcaccaagcgcucccagcagacggugaucccgaacaucgggucgcggcccugggugcgcggcgucuccagccggaucuccaucuacuggaccaucgugaagcccggcgacauccuccugaucaacagcaccgggaaccugaucgcgccccgcggcuacuucaagauccgguccgggaaguccuccaucaugcgcucggacgccccgaucggcaacugcuccagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggguucaucgagaacggcugggagggcaugguggacgggugguacggcuuccggcaccagaacucggaggggacgggccaggccgccgaccugaaguccacccaggcggccaucaaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacaaccacgacgucuaccgggacgaggcccugaacaaccgcuuccagaucaagggcguggagcucaagagcggguacaaggacuggauccuguggaucagcuucgccaucuccugcuuccugcugugcgucgugcuccugggcuucaucaugugggccugccagaagggcaacauccggugcaacaucugcaucuga

SEQ ID NO: 9018 - RNA, 1701 nt, Artificial Sequence
  derived and/or modified CDS sequence (AUadapt) from InfluenzaA__AFJ74492__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacaagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcuccaucaucucgaucuacuggacgaucgucaagcccggcgacauccuccugaucaacuccaccgggaaccugaucgcgccccgcggcuacuucaagauccggaacgggaaguccuccaucaugcgcagcgacgccccgaucggcaagugcaacuccgagugcaucacccccaacggcucgauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucggcaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguucaagaucaagggggucgagcugaaguccggcuacaaggacuggauccucuggaucucguucgccaucagcugcuuccugcugugcgugguccuccugggcuucaucaugugggccugccagaaggggaacauccgcugcaacaucugcaucuga

SEQ ID NO: 9019 - RNA, 1701 nt, Artificial Sequence
  derived and/or modified CDS sequence (AUadapt) from InfluenzaA__AFJ74525__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcgagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccaggacggcaccuccucggccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucguccaucaucagcaucuacuggaccaucgucaagcccggcgacauccuccugaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucacguacgggaccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucaaccagaucaacgggaagcucaaccggcugaucgagaagaccaacgagaaguuccaccagaucgagaaggaguucucggagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 9020 - RNA, 1701 nt, Artificial Sequence; identical to SEQ ID NO: 9018
  derived and/or modified CDS sequence (AUadapt) from InfluenzaA__AFJ74535__HA

SEQ ID NO: 9021 - RNA, 1701 nt, Artificial Sequence
  derived and/or modified CDS sequence (AUadapt) from InfluenzaA__AFJ74560__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcagaccucggggcgcgugaccgucagcaccaagcggucccagcagacggugaucccgaacaucggcucgggccccugggugcgcggggucuccagccggaucuccaucuacuggaccaucgugaagcccggcgacauccuccugaucaacucgaccgggaaccugaucgcgccccgcggcuacuucaagauccgguccggcaagagcuccaucaugcgcucggacgccccgaucgggaagugcaacuccgagugcaucacccccaacggcagcauccccaacgacaagcccuuccagaacgugaaccggaucacguacgggccgugcccccgcuacgucaagcagaacacccucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggacgggccaggccgccgaccugaaguccacccaggccgccaucaaccagaucaacggcaagcucaaccgccugguggagaagaccaacgagaaguuccaccagaucgagaaggaguucuccgaggucgaggggcggauccaggaccuggagaaguacguggaggacaccaagaucgaccucuggucguacaacgcggagcugcugguggcccucgagaaccagcacacgaucgaccugaccgacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacgucuaccgcgacgaggcccugaacaaccgguuccagaucaagggcguggagcugaaguccggcuacaaggacuggauccucuggaucucguucgcgaucagcugcuuccugcugugcaucguccuccugggguucaucaugugggccugccagaagggcaacauccgcugcaacaucugcaucuga

SEQ ID NO: 9022 - RNA, 1701 nt, Artificial Sequence
  derived and/or modified CDS sequence (AUadapt) from InfluenzaA__AFJ74634__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcagcugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 9023 - RNA, 1698 nt, Artificial Sequence
  derived and/or modified CDS sequence (AUadapt) from InfluenzaA__AFJ74653__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccucgguguccagcuucgagcgguucgagaucuucccgaaggaguccagcuggcccaaccacacggucaccgggguguccgccagcugcucccacaacggcaagucguccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgcgcccuguaccacaccgacaacgccuacgugagcgucgugagcucccacuacucgcggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 9024 - RNA, 1698 nt, Artificial Sequence
  derived and/or modified CDS sequence (AUadapt) from InfluenzaA__AFJ74673__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugcgcaagagcuacgccaacaacaaggagaaggaggugcucguccuguggggcgugcaccacccgcccaacaucggcgaccagcgggcccuguaccacaccgacaacgccuacguguccgucgugucgagccacuacucccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucagccggggguucggcuccggcaucaucaacagcaacgcccccauggacgagugcgacgcgaagugccagacgccccagggggccaucaacuccucgcugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggccaucuacuccaccguggccucgagccuggugcuccuggucucccugggggccaucagcuucuggaugugcuccaacggcagccuccagugccgcaucugcaucuga

SEQ ID NO: 9025 - RNA, 1701 nt, Artificial Sequence
  derived and/or modified CDS sequence (AUadapt) from InfluenzaA__AFJ74674__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaagaagugggaccuguucguggagcgcucgaaggccuacuccaacugcuaccccuacgacgugccggacuacgcgagccuccggucccuggucgccucguccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccgggacggacucggaccagaucucccuguacgcccaggccagcggccggaucaccgugucgaccaagcgcucccagcagaccgugaucccgaacaucggcucgcggccccgcguccgggacguguccagccgcaucuccaucuacuggacgaucgugaagcccggggacauccuccugaucaacucgaccggcaaccugaucgcgccccggggguacuucaagauccgcuccggccggucguccaucaugcgcagcgacgccccgaucggcaagugcaacuccgagugcaucacccccaacgggucgauccccaacgacaagcccuuccagaacgucaaccggaucaccuacggcgccugcccgcgcuacgugaagcagaacacgcucaagcuggccaccgggaugcggaacgugcccgagaagcagccccgcggcaucuucggggccaucgccggcuucaucgagaacggcugggaggggauggucgacggcugguacggguuccggcaccagaacuccgagggcaccgggcaggccgcggaccugaaguccacccaggccgccaucaaccagaucaacggcaagcucaaccgccugaucggcaagacgaacgagaaguuccaccagaucgagaaggaguucuccgagguggaggggcggauccaggaccuggagaaguacguggaggacaccaagaucgaccucuggucguacaacgccgagcugcuggucgcccucgagaaccagcacaccaucgaccugaccgacuccgagaugaacaagcuguucgagcgcacgaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcguggagcugaaguccggcuacaaggacuggauccucuggaucucguucgccaucagcugcuuccugcugugcgucgcccuccugggguucaucaugugggcgugccagaagggcaacauccgcugcaacaucugcaucuga

SEQ ID NO: 9026 - RNA, 1698 nt, Artificial Sequence; identical to SEQ ID NO: 9023
  derived and/or modified CDS sequence (AUadapt) from InfluenzaA__AFJ74694__HA

SEQ ID NO: 9027 - RNA, 1701 nt, Artificial Sequence
  derived and/or modified CDS sequence (AUadapt) from InfluenzaA__AFJ74695__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucguccaccgggcgcaucugcgacagcccccaccagauccuggacggcgagaacugcacccugaucgacgcccuccugggggacccccacugcgacggcuuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccgggguggcccaggacggcaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcgcgccuccgggcgggugaccgucagcaccaagcgcucgcagcagaccgugaucccgaacaucggcucccggcccugggugcgcggcgucucguccaagaucagcaucuacuggacgaucgugaagcccggggacauccuccugaucaacuccaccggcaaccugaucgcgccccggggguacuucaagauccgcucgggcaaguccagcaucaugcgguccgacgccccgaucggcaagugcaacucggagugcaucacccccaacggguccauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugguggacggcugguacggguuccgccaccagaacagcgagggcaccgggcaggccgccgaccugaaguccacgcaggccgcgaucaaccagaucaacggcaagcucaaccggcugaucgagaagaccaacgagaaguuccaccagaucgagaaggaguucucggaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacgucuaccgggacgaggcgcugaacaaccgcuuccagaucaaggggguggagcucaagucgggcuacaaggacuggauccuguggaucuccuucgccaucagcugcuuccugcugugcaucguccuccugggcuucaucaugugggccugccagaaggggaacauccggugcaacaucugcaucuga

SEQ ID NO: 9028 - RNA, 1701 nt, Artificial Sequence
  derived and/or modified CDS sequence (AUadapt) from InfluenzaA__AFJ74727__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaagucguucuucucccgccugaacuggcucacgcagcugaaguacaaguaccccgcccugaacgugaccaugcccaacaacgagaaguucgacaagcucuacaucuggggcguccaccaccccgggaccgacagcgaccagaucucccuguacgcgcaggccucgggccggaucaccgugagcacgaagcgcucccagcagaccgugaucccgaacaucggcucgcggccccgcguccgggacaucuccucgcgcaucuccaucuacuggaccaucgugaagcccggggacauccugcucaucaacagcaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcuccgggacguacgaccacgacgucuaccgggacgaggcccucaacaaccgcuuccagaucaagggcguggagcucaagucgggcuacaaggacuggauccuguggaucagcuucgccaucuccugcuuccugcugugcguggcccugcucggguucaucaugugggccugccagaagggcaacauccggugcaacaucugcaucuga

SEQ ID NO: 9029 - RNA, 1698 nt, Artificial Sequence; identical to SEQ ID NO: 9023
  derived and/or modified CDS sequence (AUadapt) from InfluenzaA__AFJ74743__HA

SEQ ID NO: 9030 - RNA, 1701 nt, Artificial Sequence; identical to SEQ ID NO: 9022
  derived and/or modified CDS sequence (AUadapt) from InfluenzaA__AFJ74744__HA

SEQ ID NO: 9031 - RNA, 1698 nt, Artificial Sequence; identical to SEQ ID NO: 9023
  derived and/or modified CDS sequence (AUadapt) from InfluenzaA__AFJ74760__HA

SEQ ID NO: 9032 - RNA, 1701 nt, Artificial Sequence
  derived and/or modified CDS sequence (AUadapt) from InfluenzaA__AFJ74761__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcagcugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacaucuccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 9033 - RNA, 1698 nt, Artificial Sequence; identical to SEQ ID NO: 9023
  derived and/or modified CDS sequence (AUadapt) from InfluenzaA__AFJ74779__HA

SEQ ID NO: 9034 - RNA, 1701 nt, Artificial Sequence; identical to SEQ ID NO: 9022
  derived and/or modified CDS sequence (AUadapt) from InfluenzaA__AFJ74780__HA

SEQ ID NO: 9035 - RNA, 1701 nt, Artificial Sequence
  derived and/or modified CDS sequence (AUadapt) from InfluenzaA__AFJ74804__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaaccgcaagugggaccuguucguggagcggucgaaggccuacuccaacugcuaccccuacgacgugccggacuacgcgagccugcgcucccucgucgccucguccgggacgcuggaguucaacaacgagucguucgacuggaccggcgugacccagaacgggaccuccagcgccugcaagcggcgcuccaacaagucguucuucucccggcugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccgcaucaccgugucgacgaagcggucccagcagaccgugaucccgaacaucggcucgcgcccccggguccgcgacguguccagccggaucuccaucuacuggaccaucgugaagcccggggacauccugcucaucaacucgaccggcaaccugaucgcgccccgcggguacuucaagauccgguccggcaagucguccaucaugcgcagcgacgccccgaucggcaagugcaacuccgagugcaucacgcccaacgggucgauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggccugccagaagggcaacauccgcugcaacaucugcaucuga

SEQ ID NO: 9036 - RNA, 1701 nt, Artificial Sequence
  derived and/or modified CDS sequence (AUadapt) from InfluenzaA__AFJ74819__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucaaccuguacgcgcaggccuccggccggaucaccgugucgacgaagcgcagccagcagaccgugaucccgaacaucggcucccggccccgcguccgggacgugucgucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 9037 - RNA, 1701 nt, Artificial Sequence; identical to SEQ ID NO: 2890
  derived and/or modified CDS sequence (AUadapt) from InfluenzaA__AFJ74842__HA

SEQ ID NO: 9038 - RNA, 1698 nt, Artificial Sequence
  derived and/or modified CDS sequence (AUadapt) from InfluenzaA__AFJ75036__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggagaacuccuggcccaaccacacggucaccggggugucggccuccugcagccacaacggcaaguccagcuucuacaagaaccugcuguggcucaccgggaagaacggccuguaccccaaccuguccaagucguacgccaacaacaaggagaaggaggugcucguccuguggggcgugcaccacccgcccaacaucggcgaccagcgggcccuguaccacaccgagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucgcggggguucggcuccggcaucaucaacagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccucgauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacuccaacgugaagaaccucuacgagaaggucaagucgcagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggccaucuacuccaccguggccucgagccuggugcuccuggucucccugggggccaucagcuucuggaugugcuccaacggcagccuccagugccgcaucugcaucuga

SEQ ID NO: 9039 - RNA, 1701 nt, Artificial Sequence; identical to SEQ ID NO: 875
  derived and/or modified CDS sequence (AUadapt) from InfluenzaA__AFJ75047__HA

SEQ ID NO: 9040 - RNA, 1698 nt, Artificial Sequence
  derived and/or modified CDS sequence (AUadapt) from InfluenzaA__AFJ75058__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgggcccuguaccacaccgagaacgccuacgugucggucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 9041 - RNA, 1698 nt, Artificial Sequence
  derived and/or modified CDS sequence (AUadapt) from InfluenzaA__AFJ75069__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaaguccaaccccgagaacgggaccugcuaccccggccacuucgccgacuacgaggagcugcgggagcagcucagcuccgugagcuccuucgagcgcuucgagaucuuccccaaggagucguccuggccgaaccacacgaccaccggggucagcgccuccugcagccacaacggcgaguccucguucuacaagaaccugcuguggcucaccgggaagaacggccuguaccccaaccuguccaagagcuacgccaacaacaaggagaaggaggugcucgugcuguggggcguccaccacccgcccaacaucggcgaccagcgggcccuguaccacacggagaacgccuacgugagcguggucuccagccacuacucccgcaaguucacccccgagaucgccaagcggcccaaggugcgcgaccaggagggccggaucaacuacuacuggacccuccuggagcccggggacaccaucaucuucgaggcgaacggcaaccugaucgcgccccgcuacgccuucgcccucucgcggggguucggcuccggcaucaucaacagcaacgccccgauggacgagugcgacgccaagugccagacgccccagggggccaucaacuccagccugcccuuccagaacgugcaccccgucaccaucggcgagugcccgaaguacgugcgcuccgccaagcugcggauggugaccgggcuccgcaacauccccucgauccagucccggggccuguucggggccaucgccggcuucaucgagggcggguggaccggcauggucgacgggugguacggcuaccaccaccagaacgagcaggggagcggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacuccaacgugaagaaccucuacgagaaggucaagucgcagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcguguaccagauccuggccaucuacucgaccgucgccuccagccuggugcuccuggugucccugggggccaucagcuucuggaugugcuccaacggcagccuccagugccgcaucugcaucuga

SEQ ID NO: 9042 - RNA, 1701 nt, Artificial Sequence
  derived and/or modified CDS sequence (AUadapt) from InfluenzaA__AFJ75091__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagaucucgcagcagaccgugaucccgaacaucggcagccgcccccggguccgcaacauccccucccggaucucgaucuacuggaccaucgugaagcccggggacauccugcucaucaacuccaccggcaaccugaucgccccgcgcggguacuucaagauccggagcggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgaccuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 9043 - RNA, 1701 nt, Artificial Sequence
  derived and/or modified CDS sequence (AUadapt) from InfluenzaA__AFJ75449__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggaagaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaccggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 9044 - RNA, 1701 nt, Artificial Sequence
  derived and/or modified CDS sequence (AUadapt) from InfluenzaA__AFJ75460__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccucgcugcggucccucgucgcgagcuccggcacccuggaguucaacaacgagucguucaacuggaccggggugacccagaacggcacguccagcgccugcauccgccgguccaacaacucguucuucucccgccugaacuggcucacccaccugaaguucaaguaccccgcccugaacgugaccaugcccaacaacgagaacuucgacaagcucuacaucuggggcguccaccaccccgggaccgacaacgaccagaucuuccuguacgcccaggcgagcgggcggaucacgguguccaccaagcgcucgcagcagaccgugaucccgaacaucggcagccggccccgcguccggaacauccccucccgcaucucgaucuacuggaccaucgugaagcccggcgacauccugcucaucaacuccacggggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacucggaggggaucggccaggccgccgaccugaaguccacccaggccgcggucgaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgccugcaucggguccauccgcaacggcacguacgaccacgacguguaccgcgacgaggcgcucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 9045 - RNA, 1698 nt, Artificial Sequence
  derived and/or modified CDS sequence (AUadapt) from InfluenzaA__AFJ75517__HA
augaaggugaagcugcucguccugcugugcaccuucaccgccacguacgccgacaccaucugcaucggcuaccacgcgaacaacucgaccgacaccguggacacggugcucgagaagaacgucaccgugaccuacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugucguccuucgagcgcuucgagaucuucccgaaggagagcuccuggcccaaccacacggucaccggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaagaagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucaaccgcggguucggcucgggcaucaucaacuccaacgcccccauggacgagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacagcaacgucaagaaccucuacgagaaggugaagacccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgcgagaagaucgacggcgucaagcucgaguccaugggcguguaccagauccuggcgaucuacucgaccguggccuccagccugguccuccuggugagccugggggccaucuccuucuggaugugcagcaacggcucccuccagugccggaucugcaucuga

SEQ ID NO: 9046 - RNA, 1698 nt, Artificial Sequence
  derived and/or modified CDS sequence (AUadapt) from InfluenzaA__AFJ75560__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugucguccuucgagcgcuucgagaucuucccgaaggagagcuccuggcccaaccacacggucaccggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucgcgcggguucggcuccggcaucaucaacagcaacgcccccauggacgagugcgacgccaagugccagacgccccagggggcgaucaacuccagccugcccuuccagaacguccacccggugaccaucggcgagugccccaaguucgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggucgggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacuccaacgucaagaaccucuacgagaaggugaagaaccagcugcgcaacaacgccaaggagaucgggaacggcugcuucgaguucuaccacaagugcaacgacgagugcauggagagcgugaagaacgggaccuacgacuaccccaaguacuccgaggagagcaagcugucccgggagaagaucgacggcgucaagcucgagucgaugggcguguaccagauccuggcgaucuacuccaccguggccagcagccugguccuccuggugucccugggggccaucagcuucuggaugugcuccaacggcagccuccagugccgcaucugcaucuga

SEQ ID NO: 9047 - RNA, 1698 nt, Artificial Sequence
  derived and/or modified CDS sequence (AUadapt) from InfluenzaA__AFJ75571__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucucguccgugagcuccuucgagcgcuucgagaucuucccgaaggagagcuccuggcccaaccacacggucaccggggugucggccuccugcagccacaacggcgagaacuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaugacccuguaccacaaggagaacgccuacgugagcgucguguccucgcacuacagccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacgagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacucgaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgcgagcggaucgacggcgucaagcucgaguccaugggcguguaccagauccuggcgaucuacucgaccguggccuccagccugguccuccuggugagccugggggccaucuccuucuggaugugcagcaacggcucccuccagugccgcaucugcaucuga

SEQ ID NO: 9048 - RNA, 1701 nt, Artificial Sequence
  derived and/or modified CDS sequence (AUadapt) from InfluenzaA__AFJ75593__HA
augaagaccaucaucgcccugucguacauccucugccugguguucgcccagaagcugcccggcaacgacuccagcaccgcgacgcucugccuggggcaccacgccgucccgaacggcaccaucgugaagaccaucaccaacgaccagaucgaggugacgaacgccaccgagcugguccaguccucguccaccggggagaucugcaacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagguggaccuguggucguacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 9049 - RNA, 1698 nt, Artificial Sequence
  derived and/or modified CDS sequence (AUadapt) from InfluenzaA__AFJ75615__HA
augaaggugaagcugcucguccugcugugcaccuucaccgccacguacgccgacaccaucugcgugggcuaccacgcgaacaacucgaccgacaccguggacacgguccucgagaagaacgugaccgugacccacuccgucaaccugcuggagaacagccacaacgggaagcucugccugcugaagggcaucgcgccccuccagcuggggaacugcuccguggccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcgucuccagcuucgagcgguucgagaucuucccgaaggaguccagcuggcccaaccacacggugaccgggguguccgccucgugcucccacaacggcgagagcuccuucuaccgcaaccugcuguggcucaccgggaagaacggccuguaccccaaccugagcaaguccuacgccaacaacaaggagaaggagguccucgugcuguggggcgugcaccacccgcccaacaucggcgaccagaaggcccuguaccacaccgagaacgccuacgucucgguggugagcucccacuacagccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacucggugaucgagaagaugaacacccaguucaccgaggucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggcgaucuacucgaccguggccagcucccugguccuccuggugagccugggggccaucuccuucuggaugugcagcaacggcucccuccagugccggaucugcaucuga

SEQ ID NO: 9050 - RNA, 1701 nt, Artificial Sequence; identical to SEQ ID NO: 5597
  derived and/or modified CDS sequence (AUadapt) from InfluenzaA__AFJ75630__HA

SEQ ID NO: 9051 - RNA, 1701 nt, Artificial Sequence; identical to SEQ ID NO: 5597
  derived and/or modified CDS sequence (AUadapt) from InfluenzaA__AFJ75641__HA

SEQ ID NO: 9052 - RNA, 1698 nt, Artificial Sequence
  derived and/or modified CDS sequence (AUadapt) from InfluenzaA__AFJ75651__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccggaccgagaacgccuacgugucggucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccgacgcccccauggacaagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 9053 - RNA, 1701 nt, Artificial Sequence
  derived and/or modified CDS sequence (AUadapt) from InfluenzaA__AFJ75662__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaccggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 9054 - RNA, 1698 nt, Artificial Sequence
  derived and/or modified CDS sequence (AUadapt) from InfluenzaA__AFJ75673__HA
augaaggugaagcugcucguccugcugugcaccuucaccgccacguacgccgacaccaucugcaucggcuaccacgcgaacaacucgaccgacaccguggacacggugcucgagaagaacgucaccgugaccuacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugucguccuucgagcgcuucgagaucuucccgaaggagagcuccuggcccaaccacacggucaccggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggcaaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucaaccgcggguucggcucgggcaucaucaacuccaacgcccccauggacgagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacagcaacgucaagaaccucuacgagaaggugaagacccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgcgagaagaucgacggcgucaagcucgaguccaugggcguguaccagauccuggcgaucuacucgaccguggccuccagccugguccuccuggugagccugggggccaucuccuucuggaugugcagcaacggcucccuccagugccggaucugcaucuga

SEQ ID NO: 9055 - RNA, 1701 nt, Artificial Sequence; identical to SEQ ID NO: 116
  derived and/or modified CDS sequence (AUadapt) from InfluenzaA__AFJ76119__HA

SEQ ID NO: 9056 - RNA, 1701 nt, Artificial Sequence; identical to SEQ ID NO: 3267
  derived and/or modified CDS sequence (AUadapt) from InfluenzaA__AFJ76131__HA

SEQ ID NO: 9057 - RNA, 1701 nt, Artificial Sequence
  derived and/or modified CDS sequence (AUadapt) from InfluenzaA__AFJ76155__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggagcaggagggccgcaugaacuacuacuggacccuggucgagcccggggacaagaucaccuucgaggcgaccggcaaccucguggugccccgguacgccuucgccauggagcgcaaggccggguccggcaucaucaucucggacacgcccguccacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacgugcccucgauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 9058 - RNA, 1698 nt, Artificial Sequence
  derived and/or modified CDS sequence (AUadapt) from InfluenzaA__AFJ76186__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucaccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccgacgcccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacucgaccguggccagcucccuggugcuccuggucagccugggggccaucuccuucuggaugugcagcaacggcucccuccagugccggaucugcaucuga

SEQ ID NO: 9059 - RNA, 1701 nt, Artificial Sequence; identical to SEQ ID NO: 116
  derived and/or modified CDS sequence (AUadapt) from InfluenzaA__AFJ76203__HA

SEQ ID NO: 9060 - RNA, 1701 nt, Artificial Sequence
  derived and/or modified CDS sequence (AUadapt) from InfluenzaA__AFJ76213__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcacucgaaguacaaguaccccgcccugaacgugaccaugcccaacaacgagaaguucgacaagcuguacaucuggggcguccaccaccccgggaccgacuccgaccagaucucgcucuacgcgcaggccagcggccggaucaccguguccacgaagcgcucgcagcagaccgugaucccgaacaucggcucccggccccgcguccgggacgugucgucccgcaucagcaucuacuggaccaucgugaagcccggggacauccugcugaucaacuccaccggcaaccucaucgcgccccggggguacuucaagauccgcucgggcaaguccucgaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcuggccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccucaaguccacccaggcggccaucaaccagaucaacggcaagcugaaccggcugaucggcaagaccaacgagaaguuccaccagaucgagaaggaguucucggagguggaggggcgcauccaggaccucgagaaguacguggaggacacgaagaucgaccugugguccuacaacgccgagcugcucgucgcccuggagaaccagcacaccaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggacguacgaccacgacguguaccgggacgaggcccugaacaaccgcuuccagaucaagggcguggagcucaagucgggcuacaaggacuggauccuguggaucagcuucgccaucuccugcuuccugcucugcgucgcccugcugggguucaucaugugggccugccagaagggcaacauccggugcaacaucugcaucuga

SEQ ID NO: 9061 - RNA, 1701 nt, Artificial Sequence
  derived and/or modified CDS sequence (AUadapt) from InfluenzaA__AFJ77408__HA
augaagaccaucaucgcccugucguacauccucugccugaucuucgcccagaagcugcccggcaacgacaacuccaccgcgacgcucugccuggggcaccacgccgugccgaacggcacccuggucaagaccaucaccaacgaccagaucgaggugacgaacgccaccgagcucgugcagagcuccucgaccgggcgcaucugcaacagcccccaccggauccuggacggcgagaacugcacccugaucgacgcccuccugggggacccccacugcgacggcuuccagaacaaggagugggaccuguucgucgagcgcucgaaggccuacuccaacugcuaccccuacgacgugccggacuacgcgagccuccggucccugguggccucguccggcacgcuggaguucaccaaggagggguucaacuggaccggcgucgcccaggacgggaaguccuacuccugcaagcgcggcagcgugaacuccuucuucucgcggcucaacuggcugcacaagcuggaguacaaguaccccgcccucaacgugaccaugcccaacaacgacaaguucgacaagcuguacaucuggggcguccaccaccccuccacggacagcgaccagaccucccuguacgugcaggcgucggggcgcgugaccgucagcaccaagcggucccagcagacggugaucccgaacaucggcucgcgccccugggugcgggggaucuccagccgcaucuccaucuacuggaccaucgucaagcccggcgacauccuccugaucaacucgaccgggaaccugaucgcgccccggggcuacuucaagauccgcaacggcaaguccagcaucaugcgguccgacgccccgaucgggaacugcaacucggagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggcuucaucgagaacgggugggagggcaugguggacgggugguacggcuuccgccaccagaacagcgaggggacgggccaggccgccgaccugaaguccacccaggccgcgaucaaccagaucaacggcaagcucaaccggcugaucgagaagaccaacgagaaguuccaccagaucgagaaggaguucucggagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacaugggcaacgggugcuucaagaucuaccacaagugcgacaacgccugcaucggcuccauccggaacgggaccuacgaccacgacguguaccgcgacgaggcgcugaacaaccgguuccagaucaagggcgucgagcucaagucgggcuacaaggacuggauccuguggaucuccuucgccaucagcugcuuccugcugugcgugguccuccugggguucaucaugugggccugccagaagggcaacauccgcugcaacaucugcaucuga

SEQ ID NO: 9062 - RNA, 1701 nt, Artificial Sequence
  derived and/or modified CDS sequence (AUadapt) from InfluenzaA__AFJ77430__HA
augaagaccaucaucgcccugucguacauccucugccugaucuucgcccagaagcugcccggcaacgacaacuccaccgcgacgcucugccuggggcaccacgccgugccgaacggcacccuggucaagaccaucaccaacgaccagaucgaggugacgaacgccaccgagcucgugcagagcuccucgaccgggcgcaucugcgacagcccccaccggauccuggacggcgagaacugcacccugaucgacgcccuccugggggaccccaacugcgacggcuuccagaacaaggagugggaccuguucgucgagcgcucgaaggccuacuccaacugcuaccccuacgacgugccggacuacgcgagccuccggucccugguggccucguccggcacgcuggaguucaccaaggagggguucaacuggaccggcgucgcccaggacgggaaguccuacuccugcaagcgcggcagcgugaacuccuucuucucgcggcucaacuggcugcacaagcuggaguacaaguaccccgcccucaacgugaccaugcccaacaacgacaaguucgacaagcuguacaucuggggcguccaccaccccuccacggacagcgaccagaucucccuguacgcgcaggccucggggcgcgugaccgugagcaccaagcggucccagcagaccgucaucccgaacaucggcucgcgccccugggugcgggggaucuccagccgcaucuccaucuacuggacgaucgugaagcccggcgacauccuccugaucaacucgaccgggaaccugaucgcgccccggggcuacuucaagauccgcaacggcaaguccagcaucaugcgguccgacgccccgaucgggaacugcaacucggagugcaucacccccaacggcuccauccccaacgacaagcccuuccagaacgucaaccgcaucaccuacggggccugcccgcgguacgugaagcagaacacgcucaagcuggccaccggcaugcgcaacgugcccgagaagcagacccgggggaucuucggcgccaucgccggcuucaucgagaacgggugggagggcauggucgacgggugguacggcuuccgccaccagaacagcgaggggaccggccaggccgccgaccugaaguccacgcaggcggccaucaaccagaucaacggcaagcucaaccggcugaucgagaagaccaacgagaaguuccaccagaucgagaaggaguucucggagguggaggggcgcauccaggaccuggagaaguacguggaggacaccaagaucgaccucugguccuacaacgccgagcugcuggucgcccucgagaaccagcacaccaucgaccugacggacagcgagaugaacaagcuguucgagcggacccgccgccagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcguggagcucaagucgggcuacaaggacuggauccuguggaucuccuucgccaucagcugcuuccugcugugcgucgugcuccugggguucaucaugugggccugccagaagggcaacauccggugcaacaucugcaucuga

SEQ ID NO: 9063 - RNA, 1701 nt, Artificial Sequence
  derived and/or modified CDS sequence (AUadapt) from InfluenzaA__AFJ77440__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccagcgagggguucaacuggaccggcguggcccaggacgggaccuccuacgccugcaagcgcggcucggugaaguccuucuucagccggcucaacuggcugcacaagcuggaguacaaguaccccgcgcucaacgucacgaugcccaacaacgacaaguucgacaagcuguacaucuggggcgugcaccaccccuccaccgacucggaccagaccucccuguacgugcaggccagcgggcgcgucaccgugucgacgaagcggucccagcagaccgugaucccgaacaucggcagccgccccuggguccgcgggguguccucgcggaucuccaucuacuggaccaucgugaagcccggcgacauccuccugaucaacagcaccgggaaccugaucgcgccccggggcuacuucaagauccgcuccggcaagucguccaucaugcggagcgacgccccgaucgggaacugcaacuccgagugcaucacgcccaacggcucgauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacuccgaggggaccggccaggccgccgaccugaaguccacccaggcggccaucaaccagaucaacggcaagcucaaccggcugaucgagaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggacguacgaccacgacguguaccgcgacgaggcccugaacaaccgguuccagaucaagggcgucgagcugaaguccggcuacaaggacuggauccucuggaucagcuucgccaucagcugcuuccugcugugcguggugcuccugggguucaucaugugggccugccagaagggcaacauccgcugcaacaucugcaucuga

SEQ ID NO: 9064 - RNA, 1701 nt, Artificial Sequence
  derived and/or modified CDS sequence (AUadapt) from InfluenzaA__AFJ77451__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccuacgccugcaagcgccggucggugaaguccuucuucagccgccucaacuggcugcacaagcuggaguacaaguaccccgcgcucaacgucaccaugcccaacaacgacaaguucgacaagcuguacaucuggggcgugcaccaccccuccacggacucggaccagaccucccuguacgugcaggccagcgggcgggucaccgugucgaccaagcgcucccagcagacggugaucccgaacaucgggagccggcccuggguccgcggcguguccucgcggaucuccaucuacuggaccaucgugaagcccggcgacauccuccugaucaacagcaccgggaaccugaucgcgccccgcggcuacuucaagauccgguccgggaaguccuccaucaugcgcucggacgccccgaucggcaacugcaacuccgagugcaucacccccaacggcagcauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggguucaucgagaacggcugggagggcauggucgacgggugguacggcuuccggcaccagaacuccgaggggacgggccaggccgccgaccucaagucgacccaggcggccaucaaccagaucaacgggaagcugaaccgccugaucgagaagaccaacggcaaguuccaccagaucgagaaggaguucuccgagguggagggccggauccaggaccuggagaaguacguggaggacaccaagaucgaccucuggagcuacaacgccgagcugcuggucgcccucgagaaccagcacacgaucgaccugaccgacuccgagaugaacaagcuguucgagcgcacccgcaagcagcuccgggagaacgccgaggacauggggaacggcugcuucaagaucuaccacaagugcgacaacgcgugcaucgggucgauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcguggugcuccugggcuucaucaugugggccugccagaaggggaacauccggugcaacaucugcaucuga

SEQ ID NO: 9065 - RNA, 1701 nt, Artificial Sequence
  derived and/or modified CDS sequence (AUadapt) from InfluenzaA__AFJ77462__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccuccugaucaacuccaccgggaaccugaucgcgccccggggcuacuucaagauccgcucgggcaaguccagcaucaugcgguccgacgccccgaucgggaacugcaacucggagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucucggagguggaggggcgcauccaggaccuggagaaguacguggaggacacgaagaucgaccucugguccuacaacgccgagcugcuggucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagucgggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 9066 - RNA, 1701 nt, Artificial Sequence
  derived and/or modified CDS sequence (AUadapt) from InfluenzaA__AFJ77473__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccagauccucgacggcgagaacugcacccugaucgacgcccugcucggggacccccacugcgacggcuuccagaacaaggagugggaccuguucguggagcggagcaaggccuacuccaacugcuaccccuacgacgugccggacuacgcgucgcugcgcucccucgucgccagcuccggcacgcuggaguucaacaacgagucguucaacuggaccgggguggcccagaacggcaccuccagcgccugcaagcggcgcuccaucaagucguucuucucccggcugaacuggcuccaccagcugaaguacaaguaccccgcgcugaacgugaccaugcccaacaacgagaaguucgacaagcucuacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccugcucaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcugaagcucgccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcugaaccggcucaucgagaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcgugguccugcucggcuucaucaugugggccugccagaagggcaacauccggugcaacaucugcaucuga

SEQ ID NO: 9067 - RNA, 1701 nt, Artificial Sequence; identical to SEQ ID NO: 431
  derived and/or modified CDS sequence (AUadapt) from InfluenzaA__AFJ77484__HA

SEQ ID NO: 9068 - RNA, 1701 nt, Artificial Sequence; identical to SEQ ID NO: 433
  derived and/or modified CDS sequence (AUadapt) from InfluenzaA__AFJ77495__HA

SEQ ID NO: 9069 - RNA, 1701 nt, Artificial Sequence; identical to SEQ ID NO: 431
  derived and/or modified CDS sequence (AUadapt) from InfluenzaA__AFJ77506__HA

SEQ ID NO: 9070 - RNA, 1701 nt, Artificial Sequence
  derived and/or modified CDS sequence (AUadapt) from InfluenzaA__AFJ77517__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaacaacgagucguucaacuggaccgggguggcccagaacggcaccuccaacgccugcaagcgccggucgaugaaguccuucuucagccgccugaacuggcuccaccagcugaaguacaaguaccccgcgcugaacgugaccaugcccaacaacgacaaguucgacaagcucuacaucuggggcguccaccaccccuccacggacucggaccagaccucccuguacgcccaggccagcgggcgggugaccgugucgacccagcgcucccagcagacggucaucccgaacaucgggagccggcccugggugcgcggcguguccucgcggaucuccaucuacuggaccaucgucaagcccggcgacauccugcucaucaacucgaccgggaaccugaucgcgccccgcggcuacuucaagauccgguccgggaaguccuccaucauccgcagcgacgccccgaucggcaagugcaacuccgagugcaucacccccaacggcucgauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucucguucgccaugagcugcuuccuccugugcgugguccugcucggcuucaucaugugggccugccagaagggcaacauccggugcaacaucugcaucuga

SEQ ID NO: 9071 - RNA, 1701 nt, Artificial Sequence; identical to SEQ ID NO: 268
  derived and/or modified CDS sequence (AUadapt) from InfluenzaA__AFJ77528__HA

SEQ ID NO: 9072 - RNA, 1698 nt, Artificial Sequence
  derived and/or modified CDS sequence (AUadapt) from InfluenzaA__AFJ77550__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccagauccucgacggcgagaacugcacccugaucgacgcccugcucggggacccccacugcgacggcuuccagaacaaggagugggaccuguucguggagcggucgaaggccuacuccaacugcuaccccuacgacgugccggacuacgcgagccugcgcucccucgucgccucguccggcacgcuggaguucaacaacgagagcuucaacuggaccgggguggcccagaacggcaccuccucggccugcaagcggcgcuccaucaagagcuucuucucccggcugaacuggcuccaccagcugaaguacaaguaccccgcgcugaacgugaccaugcccaacaacgagaaguucgacaagcucuacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucagcaucuacuggacgaucgucaagcccggcgacauccugcucaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucaccuacggggccugcccgcgguacgugaagcagaacacgcugaagcucgccaccggcaugcgcaacguccccgagaagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcugaaccggcucaucgagaagaccaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucucguucgccaucuccugcuuccuccugugcgugguccugcucggcuucaucaugugggccugccagaagggcaacauccggugcagcaucugcaucuga

SEQ ID NO: 9073 - RNA, 1701 nt, Artificial Sequence
  derived and/or modified CDS sequence (AUadapt) from InfluenzaA__AFJ77561__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccuacgccugcaagcgccggagcgugaaguccuucuucucgcgccucaacuggcugcacaagcuggaguacaaguaccccgcgcucaacgucaccaugcccaacaacgacaaguucgacaagcuguacaucuggggcgugcaccaccccuccacggacagcgaccagaccucccuguacgcccaggccucggggcgggugaccgucagcaccaagcgcucccagcagacggugaucccgaacaucgggucgcggcccugggugcgcggcgucuccagccggaucuccaucuacuggaccaucgugaagcccggcgacauccuccugaucuacagcaccgggaaccugaucgcgccccgcggcuacuucaagauccgguccgggaaguccuccaucaugcgcucggacgccccgaucggcaacugcuccagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggguucaucgagaacggcugggagggcaugguggacgggugguacggcuuccggcaccagaacucggaggggacgggccaggccgcggaccugaaguccacccaggccgccaucaaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacucggagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucagcuucgccaucuccugcuuccugcugugcgucgugcuccugggcuucaucaugugggccugccagaagggcaacauccggugcaacaucugcaucuga

SEQ ID NO: 9074 - RNA, 1698 nt, Artificial Sequence
  derived and/or modified CDS sequence (AUadapt) from InfluenzaA__AFJ77572__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccagauccucgacggcgagaacugcacccugaucgacgcccugcucggggacccccacugcgacggcuuccagaacaaggagugggaccuguucguggagcggucgaaggccuacuccaacugcuaccccuacgacgugccggacuacgcgagccugcgcucccucgucgccucguccggcacgcuggaguucaacaacgagagcuucaacuggaccgggguggcccagaacggcaccuccucggccugcaagcggcgcuccaucaagagcuucuucucccggcugaacuggcuccaccagcugaaguacaaguaccccgcgcugaacgugaccaugcccaacaacgagaaguucgacaagcucuacaucuggggcguccaccaccccucgacggacuccgaccagaucagccuguacgcccaggccucggggcgcgugaccguguccaccaagcggagccagcagaccgucaucccgaacaucggguccggccccugggugcgcggcgugucgucccggaucagcaucuacuggacgaucgucaagcccggggacauccugcucaucaacuccaccggcaaccugaucgcgccccgcggguacuucaagauccggucgggcaaguccagcaucaugcgcuccgacgccccgaucggcaagugcaacucggagugcaucacccccaacggguccauccccaacgacaagcccuuccagaacgugaaccggaucaccuacggcgccugcccgcgcuacgugaagcagaacacgcugaagcucgccaccgggaugcggaacguccccgagaagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcugaaccgccucaucgagaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagcgcaccaagaagcagcugcgggagaacgcggaggacauggggaacggcugcuucaagaucuaccacaagugcgacaacgccugcaucggguccauccgcaacggcaccuacgaccacgacguguaccgcgacgaggcccucaacaaccgguuccagaucaagggggucgagcugaaguccggcuacaaggacuggauccuguggaucucguucgccaucuccugcuuccuccugugcgugguccugcucggcuucaucaugugggccugccagaaggggaacauccgcugcagcaucugcaucuga

SEQ ID NO: 9075 - RNA, 1701 nt, Artificial Sequence
  derived and/or modified CDS sequence (AUadapt) from InfluenzaA__AFJ77583__HA
augaagaccaucaucacccugucguacauccucugccugguguucgcccagaagcugcccgucaaggacaacuccacggccacccucugccugggccaccacgcggugccgaacgggacccuggugaagaccaucacgaacgaccacaucgaggucaccaacgccaccgagcucgugcagagcuccucgaccggccgcaucugcgacagcccccaccagauccuggacggggagaacugcacgcugaucgacgcccuccugggcgacccccacugcgacggguuccagaacaaggagugggaccuguucguggagcggucgaccgccuacuccaacugcuaccccuacgacgucccggacuacgccagccuccgcucccugguggcgucguccggcacccuggaguucaacaacgagagcuucaacuggaccggcguggcccagaacgggacguccagcgccugcaagcggcgcuccaucaagucguucuucucccggcucaacuggcugcaccagcugaaguacaaguaccccgcccucaacgucaccaugcccaacaacgagaaguucgacaagcuguacaucuggggcgugcaccaccccagcaccgacuccgaccagaucucgcuguacgcgcaggccagcgggcgcgugaccgucuccacgaagcggucgcagcagaccgugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacgcccaacggcuccauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacgggugggagggcaugguggacggcugguacggguuccgccaccagaacagcgagggcaccgggcaggccgccgaccugaaguccacccaggcggccaucaaccagaucaacggcaagcucaaccggcugaucgagaagaccaacgagaaguuccaccagaucgagaaggaguucucggaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgccgaggacaugggcaacggcugcuucaagaucuaccacaagugcgacaacgcgugcaucggguccauccggaacggcacguacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 9076 - RNA, 1701 nt, Artificial Sequence
  derived and/or modified CDS sequence (AUadapt) from InfluenzaA__AFJ77594__HA
augaagaccaucaucgcccugucguacauccucugccugguguucgcccagaagcugcccgucaaggacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 9077 - RNA, 1701 nt, Artificial Sequence
  derived and/or modified CDS sequence (AUadapt) from InfluenzaA__AFJ77605__HA
augaagaccaucaucgcccugucguacauccucugccugaucuucgcccagaagcugcccggcaacgacaacuccaccgcgacgcucugccuggggcaccacgccgugccgaacggcacccuggucaagaccaucaccaacgaccagaucgaggugacgaacgccaccgagcucgugcagucguccagcaccgggaagaucugcgacucgccccaccagauccuggacggcgagaacugcacccugaucgacgcccuccugggggacccccacugcgacggcuuccagaacaaggagugggaccuguucgucgagcgcagcaaggccuacuccaacugcuaccccuacgacgugccggacuacgcgucgcuccggucccugguggccagcuccggcacgcuggaguucaacaacgagucguucaacuggaccggggucgcccagaacggcaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcgugcaccaccccagcacggacuccgaccagaucucgcuguacgcccaggccagcgggcgggucaccguguccaccaagcgcucgcagcagaccgugaucccgaacaucgggucccggcccuggguccgcggcgugagcucccggaucucgaucuacuggacgaucgugaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcucaagcuggccaccggcaugcggaacgugcccgagaagcagacccgcgggaucuucggcgccaucgccggguucaucgagaacggcugggagggcauggucgacgggugguacggcuuccggcaccagaacucggaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacaccaucgaccugacggacucggagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacguguaccgcgacgaggccgugaacaaccgguuccagaucaagggcgucgagcugaaguccggguacaaggacuggauccuguggaucagcuucgccaucuccugcuuccuccugugcgugguccugcucggcuucaucaugugggccugccagaagggcaacauccgcugcaacaucugcaucuga

SEQ ID NO: 9078 - RNA, 1701 nt, Artificial Sequence
  derived and/or modified CDS sequence (AUadapt) from InfluenzaA__AFJ77616__HA
augaagaccaucaucgcccugucguacauccucugcauggugcuggcccagaagcugcccgucaaggacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccagcgggcgcgugaccgucuccaccaagcggucgcagcagacggugaucccgaacaucggcucccgccccugggugcgcggggucagcucccggaucucgaucuacuggaccaucgugaagcccggcgacauccuccugaucaacuccaccggcaaccugaucgcgccccggggguacuucaagauccgcagcggcaaguccucgaucaugcgguccaacgccagcaucgggaagugcaacuccgagugcaucaccccgaacggcucgauccccaacgacaagcccuuccagaacgugaaccgcaucacguacggcgccugcccccgguacgucaagcagaacacccucaagcuggccaccgggaugcgcaacgugccggagaagcagacccggggcaucuucggggccaucgccggcuucaucgagaacgggugggagggcaugguggacggcugguacggguuccgccaccagaacuccgagggcacggggcaggccgcggaccugaaguccacccaggccgccaucaaccagaucaacggcaagcucaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggucgauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 9079 - RNA, 1701 nt, Artificial Sequence
  derived and/or modified CDS sequence (AUadapt) from InfluenzaA__AFJ77627__HA
augaagaccaucaucgcccugucguacauccucugccuggugcuggcccagaagcuccccgucaaggacaacuccaccgcgacgcugugccugggccaccacgccgugccgaacgggacccucgugaagaccaucaccaacgaccacaucgaggucacgaacgccaccgagcuggugcagagcuccucgaccggccgcaucugcgacagcccccaccagauccuggacggggagaacugcacccucaucgacgcccugcugggcgacccccacugcgacggguuccagaacaaggagugggaccucuucguggagcgguccacggccuacuccaacugcuaccccuacgacgucccggacuacgcgucgcugcgcucccugguggccagcuccggcacccucgaguucaacaacgagucguucaacuggaccggcguggcccagaacgggaccuccagcgccugcaagcggcgcuccaucaagucguucuucucccggcugaacuggcugcaccagcucaaguacaaguaccccgcgcugaacgucacgaugcccaacaacgagaaguucgacaagcuguacaucuggggcgugcaccaccccagcaccgacuccgaccagaucucgcucuacgcccaggccagcgggcgcgugaccgucuccaccaagcggagccagcagacggugaucccgaacaucggcucccgccccugggugcgcggggucucgucccggaucagcaucuacuggaccaucgugaagcccggcgacauccugcugaucaacuccaccggcaaccucaucgcgccccggggguacuucaagauccgcucgggcaaguccagcaucaugcgguccaacgccucgaucgggaagugcaacuccgagugcaucaccccgaacggcagcauccccaacgacaagcccuuccagaacgugaaccgcaucacguacggcgccugcccccgguacgucaagcagaacacccugaagcuggccaccgggaugcgcaacgugccggagaagcagacccggggcaucuucggggccaucgccggcuucaucgagaacgggugggagggcaugguggacggcugguacggguuccgccaccagaacuccgagggcacggggcaggccgcggaccucaagucgacccaggccgccaucaaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggucgauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 9080 - RNA, 1701 nt, Artificial Sequence
  derived and/or modified CDS sequence (AUadapt) from InfluenzaA__AFJ77638__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaccacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacucggaggggacgggccaggccgcggaccugaaguccacccaggccgccaucaaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacacgaucgaccugaccgacucggagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 9081 - RNA, 1701 nt, Artificial Sequence
  derived and/or modified CDS sequence (AUadapt) from InfluenzaA__AFJ77649__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacaacaccgggaaccugaucgcgccccggggcuacuucaagauccgcaacgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuucaagaucaagggggucgagcugaaguccggcuacaaggacuggauccucuggaucuccuucgccaucagcugcuuccugcugugcgugguccuccugggcuucaucaugugggccugccagaaggggaacauccggugcaacaucugcaucuga

SEQ ID NO: 9082 - RNA, 1701 nt, Artificial Sequence; identical to SEQ ID NO: 448
  derived and/or modified CDS sequence (AUadapt) from InfluenzaA__AFJ77660__HA

SEQ ID NO: 9083 - RNA, 1701 nt, Artificial Sequence; identical to SEQ ID NO: 448
  derived and/or modified CDS sequence (AUadapt) from InfluenzaA__AFJ77671__HA

SEQ ID NO: 9084 - RNA, 1701 nt, Artificial Sequence; identical to SEQ ID NO: 448
  derived and/or modified CDS sequence (AUadapt) from InfluenzaA__AFJ77682__HA

SEQ ID NO: 9085 - RNA, 1701 nt, Artificial Sequence
  derived and/or modified CDS sequence (AUadapt) from InfluenzaA__AFJ77693__HA
augaagaccaucaucgcccugucguacauccucugccugguguucgcccagaagcugcccgucaacgacaacuccaccgcgacgcucugccugggccaccacaccgugccgaacgggacccuggugaagaccaucacgaacgacaacaucgaggucaccaacgccaccgagcucgugcagagcuccucgaccggccgcaucugcgacagcccccaccagauccuggacggggagaacugcacgcugaucgacgcccuccugggcgacccccacugcgacggguuccagaacaaggagugggaccuguucguggagcggucgaccgccuacuccaacugcuaccccuacgacgucccggacuacgccagccuccgcucccugguggcgucguccggcacccuggaguucaacaacgagagcuucaacuggaccggcguggaccagaacgggacguccagcgccugcaagcggcgcuccaacaagucguucuucucccggcucaacuggcugcaccagcugaaguacaaguaccccgcccucaacgucaccaugcccaacaacgagaaguucgacaagcuguacaucuggggcgugcaccaccccagcaccgacuccgaccagaucucgcuguacgcccaggcgagcgggcgcgugaccgucuccacgaagcggucgcagcagaccgugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacgcccaacggcuccauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacgggugggagggcaugguggacggcugguacggguuccgccaccagaacuucgagggcaccgggcaggccgccgaccugaaguccacccaggccgcgaucaaccagaucaacggcaagcucaaccggcugaucgagaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacaugggcaacggcugcuucaagaucuaccacaagugcgacaacgccugcaucgggucgauccggaacggcacguacgaccacgacgucuaccgcgacgaggcgcugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 9086 - RNA, 1701 nt, Artificial Sequence; identical to SEQ ID NO: 448
  derived and/or modified CDS sequence (AUadapt) from InfluenzaA__AFJ77704__HA

SEQ ID NO: 9087 - RNA, 1701 nt, Artificial Sequence; identical to SEQ ID NO: 8926
  derived and/or modified CDS sequence (AUadapt) from InfluenzaA__AFJ77715__HA

SEQ ID NO: 9088 - RNA, 1701 nt, Artificial Sequence; identical to SEQ ID NO: 8926
  derived and/or modified CDS sequence (AUadapt) from InfluenzaA__AFJ77726__HA

SEQ ID NO: 9089 - RNA, 1701 nt, Artificial Sequence; identical to SEQ ID NO: 9022
  derived and/or modified CDS sequence (AUadapt) from InfluenzaA__AFJ77737__HA

SEQ ID NO: 9090 - RNA, 1701 nt, Artificial Sequence; identical to SEQ ID NO: 277
  derived and/or modified CDS sequence (AUadapt) from InfluenzaA__AFJ77748__HA

SEQ ID NO: 9091 - RNA, 1701 nt, Artificial Sequence; identical to SEQ ID NO: 277
  derived and/or modified CDS sequence (AUadapt) from InfluenzaA__AFJ77759__HA

SEQ ID NO: 9092 - RNA, 1701 nt, Artificial Sequence
  derived and/or modified CDS sequence (AUadapt) from InfluenzaA__AFJ77781__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacagcgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccagcggccggaucaccguguccacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 9093 - RNA, 1701 nt, Artificial Sequence; identical to SEQ ID NO: 2040
  derived and/or modified CDS sequence (AUadapt) from InfluenzaA__AFJ77792__HA

SEQ ID NO: 9094 - RNA, 1701 nt, Artificial Sequence; identical to SEQ ID NO: 2040
  derived and/or modified CDS sequence (AUadapt) from InfluenzaA__AFJ77803__HA

SEQ ID NO: 9095 - RNA, 1701 nt, Artificial Sequence; identical to SEQ ID NO: 2040
  derived and/or modified CDS sequence (AUadapt) from InfluenzaA__AFJ77814__HA

SEQ ID NO: 9096 - RNA, 1701 nt, Artificial Sequence; identical to SEQ ID NO: 2040
  derived and/or modified CDS sequence (AUadapt) from InfluenzaA__AFJ77825__HA

SEQ ID NO: 9097 - RNA, 1701 nt, Artificial Sequence; identical to SEQ ID NO: 2040
  derived and/or modified CDS sequence (AUadapt) from InfluenzaA__AFJ77836__HA

SEQ ID NO: 9098 - RNA, 1701 nt, Artificial Sequence; identical to SEQ ID NO: 2040
  derived and/or modified CDS sequence (AUadapt) from InfluenzaA__AFJ77847__HA

SEQ ID NO: 9099 - RNA, 1701 nt, Artificial Sequence
  derived and/or modified CDS sequence (AUadapt) from InfluenzaA__AFJ77858__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgcagcgcucgcagcagaccgugaucccgaacaucggcucccggccccgcguccgggacauccccagccgcaucuccaucuacuggaccaucgugaagcccggggacaugcugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaacaagcucaucggcaagaccaacgagaaguuccaccagaucgagaaggaguucuccgaggucgaggggcggauccaggaccuggagaaguacguggaggacacgaagaucgaccuguggagcuacaacgccgagcuccugguggcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggacguacgaccacgacgucuaccgcgacgaggcccucaacaaccgguuccagaucaagggcguggagcugaaguccggcuacaaggacuggauccuguggaucagcuucgccaucuccugcuuccucuucugcguggcccugcugggguucaucaugugggccugccagaagggcaacauccgcugcaacaucugcaucuga

SEQ ID NO: 9100 - RNA, 1701 nt, Artificial Sequence
  derived and/or modified CDS sequence (AUadapt) from InfluenzaA__AFJ77869__HA
augaagaccaucaucgccuucucguacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccuggucgccagcuccgggacgcucgaguucaacaacgagucguucaacuggaccggcgugacccagaacgggaccuccagcgccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaucucgcucuacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcugaucaacagcaccggcaaccucaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagucgacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacacgaagaucgaccuguggagcuacaacgccgagcugcucguggcccuggagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggacguacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 9101 - RNA, 1701 nt, Artificial Sequence
  derived and/or modified CDS sequence (AUadapt) from InfluenzaA__AFJ77880__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcaacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 9102 - RNA, 1701 nt, Artificial Sequence
  derived and/or modified CDS sequence (AUadapt) from InfluenzaA__AFJ77902__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucggccuguacgcgcaggccagcggccggaucaccguguccacgaagcgcucgcagcagaccgugaucccgaacaucgggucgcggccccgcguccgggacauccccucccgcaucagcaucuacuggaccaucgugaagcccggcgacaugcugcucaucaacuccaccgggaaccugaucgccccgcggggcuacuucaagauccgcucgggcaaguccucgaucaugcgguccgacgcccccaucgggaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccugaaguccacccaggcggccaucaaccagaucaacggcaagcugaaccggcucaucgggaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggccugccagaaggggaacauccggugcaacaucugcaucuga

SEQ ID NO: 9103 - RNA, 1701 nt, Artificial Sequence
  derived and/or modified CDS sequence (AUadapt) from InfluenzaA__AFJ77913__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugcaggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguacccggcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugauccccaacaucggcucccggccgcgcguccgggacauccccucgcgcaucuccaucuacuggaccaucgugaagcccggggacaugcugcucaucaacagcaccggcaaccugaucgcgccccggggguacuucaagauccgcuccggcaagucguccaucaugcggucggacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 9104 - RNA, 1701 nt, Artificial Sequence; identical to SEQ ID NO: 1358
  derived and/or modified CDS sequence (AUadapt) from InfluenzaA__AFJ77924__HA

SEQ ID NO: 9105 - RNA, 1701 nt, Artificial Sequence
  derived and/or modified CDS sequence (AUadapt) from InfluenzaA__AFJ77935__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccucgaccgggggcaucugcgacagcccccaccagauccucgacggggagaacugcacccugauggacgcccugcucggcgacccccagugcgacggcuuccagaacaagaagugggaccuguucguggagcgcucgaaggccuacuccaacugcuaccccuacgacgucccggaccacgcgucgcugcggucccucguggccagcuccgggacgcuggaguucaacaacgagucguucaacuggaccggcgugacccagaacgggaccuccucggccugcaagcgccgguccaacaacucguucuucucccgccugaacuggcucacgcaccugaaguucaaguaccccgcccugaacgucaccaugcccaacaacgagaccuucgacaagcucuacaucuggggcgugcaccaccccgggaccgacaacgaccagaucagccuguacgcgcaggccuccggccggaucacggugucgaccaagcgcucgcagcagaccgucaucccgaacaucggcucccggccccgcgugcgggacauccccagccgcaucuccaucuacuggaccaucgugaagcccggggacauccugcucaucaacucgacgggcaaccugaucgccccgcggggguacuucaagauccgcuccggcaagucguccaucaugcggucggacgcccccaucggcaagugcaacuccgagugcaucacccccaacgggagcauccccaacgacaagccguuccagaacgucaaccgcaucaccuacggcgccugcccccgguacgugaagcagaacacccugaagcucgcgacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 9106 - RNA, 1701 nt, Artificial Sequence
  derived and/or modified CDS sequence (AUadapt) from InfluenzaA__AFJ77946__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacaugcugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacaucaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcgucgagcugaaguccggcuacaaggacuggaucaucuggaucagcuucgccaucuccugcuuccugcucugcguggcccugcugggguucaucaugugggccugccagaagggcaacauccggugcaacaucugcaucuga

SEQ ID NO: 9107 - RNA, 1701 nt, Artificial Sequence; identical to SEQ ID NO: 1998
  derived and/or modified CDS sequence (AUadapt) from InfluenzaA__AFJ77957__HA

SEQ ID NO: 9108 - RNA, 1701 nt, Artificial Sequence; identical to SEQ ID NO: 875
  derived and/or modified CDS sequence (AUadapt) from InfluenzaA__AFJ77968__HA

SEQ ID NO: 9109 - RNA, 1701 nt, Artificial Sequence
  derived and/or modified CDS sequence (AUadapt) from InfluenzaA__AFJ77979__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugcggucgggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 9110 - RNA, 1701 nt, Artificial Sequence
  derived and/or modified CDS sequence (AUadapt) from InfluenzaA__AFJ77990__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgaguaccgggacgaggcccucaacaaccgcuuccagaucaagggcgucgagcugaaguccggcuacaaggacuggauccuguggaucuccuucgccaucagcugcuuccuccugugcgugacgcugcucggguucaucaugugggccugccagaagggcaacauccggugcaacaucugcaucuga

SEQ ID NO: 9111 - RNA, 1701 nt, Artificial Sequence
  derived and/or modified CDS sequence (AUadapt) from InfluenzaA__AFJ78001__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacgggaagaacugcacccugaucgacgcccugcucggcgacccccagugcgacgacuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugacgcugcucggcuucaucaugugggccugccagaaggggaacauccggugcaacaucugcaucuga

SEQ ID NO: 9112 - RNA, 1701 nt, Artificial Sequence
  derived and/or modified CDS sequence (AUadapt) from InfluenzaA__AFJ78012__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggcccacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 9113 - RNA, 1701 nt, Artificial Sequence
  derived and/or modified CDS sequence (AUadapt) from InfluenzaA__AFJ78023__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcaaguccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccgcaucaccguguccacgaagcggagccagcagaccgugaucccgaacaucggcucgcgcccccggguccgcaacauccccucccggaucagcaucuacuggaccaucgugaagcccggggacauccugcucaucaacuccaccggcaaccugaucgccccgcgcggguacuucaagauccggucgggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 9114 - RNA, 1701 nt, Artificial Sequence; identical to SEQ ID NO: 875
  derived and/or modified CDS sequence (AUadapt) from InfluenzaA__AFJ78034__HA

SEQ ID NO: 9115 - RNA, 1701 nt, Artificial Sequence
  derived and/or modified CDS sequence (AUadapt) from InfluenzaA__AFJ78045__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagccgggccuacuccaacugcuaccccuacgacgugccggacuacgcgucgcugcgcucccucgucgccagcuccgggacgcuggaguucaacaacgagucguucaacuggaccggcgugacccagaacgggaccuccucggccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccgcaucaccguguccacgaagcggagccagcagaccgugaucccgaacaucggcucgcgcccccggguccgcaacauccccucccggaucagcaucuacuggaccaucgugaagcccggggacauccugcucaucaacuccaccggcaaccugaucgccccgcgcggguacuucaagauccggucgggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcauggggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacaucaagugcaacaucugcaucuga

SEQ ID NO: 9116 - RNA, 1701 nt, Artificial Sequence; identical to SEQ ID NO: 875
  derived and/or modified CDS sequence (AUadapt) from InfluenzaA__AFJ78056__HA

SEQ ID NO: 9117 - RNA, 1701 nt, Artificial Sequence
  derived and/or modified CDS sequence (AUadapt) from InfluenzaA__AFJ78067__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggccgguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 9118 - RNA, 1701 nt, Artificial Sequence
  derived and/or modified CDS sequence (AUadapt) from InfluenzaA__AFJ78078__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucgacaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 9119 - RNA, 1701 nt, Artificial Sequence; identical to SEQ ID NO: 9042
  derived and/or modified CDS sequence (AUadapt) from InfluenzaA__AFJ78089__HA

SEQ ID NO: 9120 - RNA, 1701 nt, Artificial Sequence; identical to SEQ ID NO: 2073
  derived and/or modified CDS sequence (AUadapt) from InfluenzaA__AFJ78100__HA

SEQ ID NO: 9121 - RNA, 1701 nt, Artificial Sequence
  derived and/or modified CDS sequence (AUadapt) from InfluenzaA__AFJ78111__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaacuucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 9122 - RNA, 1701 nt, Artificial Sequence
  derived and/or modified CDS sequence (AUadapt) from InfluenzaA__AFJ78122__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagucguccagcaccgggggcaucugcgacucgccccaccagauccucgacggggagaacugcacccugaucgacgcccugcucggcgacccccagugcgacggcuuccagaacaagaagugggaccuguucgucgagcgcagcaaggccuacuccaacugcuaccccuacgacgugccggacuacgcgucgcugcggucccucguggccagcuccgggacgcuggaguucaacaacgagucguucaacuggaccggcgucacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucuuccuguacgcgcaggccucgggccggaucaccgucuccacgaagcgcagccagcagaccgugaucccgaacaucggcucgcggccccgcgugcggaacauccccucccgcaucagcaucuacuggaccaucgucaagcccggggacauccugcucaucaacuccaccggcaaccugaucgccccgcggggguacuucaagauccgcucgggccgguccucgaucaugcgcuccgacgcccccaucgacaagugcaacagcgagugcaucacgcccaacggcuccauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucauccggaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcugaaguccggguacaaggacuggauccuguggaucuccuucgccaucagcugcuuccuccugugcguggcccugcucggcuucaucaugugggccugccagaagggcaacauccgcugcaacaucugcaucuga

SEQ ID NO: 9123 - RNA, 1701 nt, Artificial Sequence
  derived and/or modified CDS sequence (AUadapt) from InfluenzaA__AFJ78144__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucguccugcauccgccggagcaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcccaggcguccgggcggaucaccgugagcacgaagcgcucgcagcagaccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucgaccagaucaacgggaagcugaaccggcugaucggcaagaccaacgagaaguuccaccagaucgagaaggaguucuccgaggucgagggccgcauccaggaccuggagaaguacguggaggacaccaagguggaccuguggucguacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgccugcaucgggagcauccgcaacggcaccuacgaccacgacguguaccgcgacgaggcgcucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 9124 - RNA, 1701 nt, Artificial Sequence; identical to SEQ ID NO: 9123
  derived and/or modified CDS sequence (AUadapt) from InfluenzaA__AFJ78155__HA

SEQ ID NO: 9125 - RNA, 1701 nt, Artificial Sequence
  derived and/or modified CDS sequence (AUadapt) from InfluenzaA__AFJ78166__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagcggcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 9126 - RNA, 1701 nt, Artificial Sequence; identical to SEQ ID NO: 1974
  derived and/or modified CDS sequence (AUadapt) from InfluenzaA__AFJ78177__HA

SEQ ID NO: 9127 - RNA, 1701 nt, Artificial Sequence
  derived and/or modified CDS sequence (AUadapt) from InfluenzaA__AFJ78188__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcauccggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggaccggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 9128 - RNA, 1701 nt, Artificial Sequence
  derived and/or modified CDS sequence (AUadapt) from InfluenzaA__AFJ78210__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaccggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggaucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 9129 - RNA, 1701 nt, Artificial Sequence; identical to SEQ ID NO: 9053
  derived and/or modified CDS sequence (AUadapt) from InfluenzaA__AFJ78221__HA

SEQ ID NO: 9130 - RNA, 1701 nt, Artificial Sequence
  derived and/or modified CDS sequence (AUadapt) from InfluenzaA__AFJ78232__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggaagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaccggccaggccgccgaccugaaguccacccaggcggccaucgaccagaucaacgggaagcugaaccggcucaucggcaagaccaacgagaaguuccaccagaucgagaacgaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 9131 - RNA, 1701 nt, Artificial Sequence
  derived and/or modified CDS sequence (AUadapt) from InfluenzaA__AFJ78243__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgaaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccgugggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccacaagaacucggaggggaccggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 9132 - RNA, 1701 nt, Artificial Sequence
  derived and/or modified CDS sequence (AUadapt) from InfluenzaA__AFJ78254__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagguggaccugugguccuacaacgccgagcuccuggucgcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 9133 - RNA, 1701 nt, Artificial Sequence; identical to SEQ ID NO: 9132
  derived and/or modified CDS sequence (AUadapt) from InfluenzaA__AFJ78265__HA

SEQ ID NO: 9134 - RNA, 1701 nt, Artificial Sequence
  derived and/or modified CDS sequence (AUadapt) from InfluenzaA__AFJ78276__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagguggaccugugguccuacaacgccgagcuccuggucgcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 9135 - RNA, 1701 nt, Artificial Sequence
  derived and/or modified CDS sequence (AUadapt) from InfluenzaA__AFJ78287__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugauggacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccucggggcggaucaccguguccacgaagcgcagccagcagaccgugauccccaacaucggcucgcggccccgcguccggaacauccccucccgcaucucgaucuacuggaccaucgugaagccgggcgacauccugcugaucaacuccaccgggaaccucaucgcgccccggggcuacuucaagauccgcagcgggaaguccucgaucaugcgguccgacgcccccaucggcaagugcaacagcgagugcaucacgcccaacggcuccaucccgaacgacaagcccuuccagaacgugaaccgcaucaccuacggggccugcccccgguacgucaagcagaacacccugaagcuggccaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccucaaguccacccaggcggccaucgaccagaucaacgggaagcugaaccgccugaucggcaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagucgggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 9136 - RNA, 1698 nt, Artificial Sequence
  derived and/or modified CDS sequence (AUadapt) from InfluenzaA__AFJ78309__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugucguccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagucguacgugaacaacaaggagaaggaggugcugguccucuggggcgugcaccaccccagcaacaucggggaccagcgggccaucuaccacacggagaacgccuacguguccgucgugagcucccacuacagccgccgguucaccccggagaucgccaagcgccccaaggugcgggaccaggagggccgcaucaacuacuacuggacccugcuggagcccggcgacaccaucaucuucgaggcgaacgggaaccucaucgcccccugguacgccuucgcccugucccggggcuucgggagcggcaucaucacguccaacgccccgauggacgagugcgacgcgaagugccagacgccccagggcgccaucaacucgucccugcccuuccagaacguccaccccaucaccaucggggagugcccgaaguacgugcgcagcgccaagcuccggauggugaccggccugcgcaacauccccuccauccagagccgggggcuguucggcgccaucgccggguucaucgagggcggcuggaccgggaugaucgacggcugguacggguaccaccaccagaacgagcagggcuccggguacgcggccgaccagaaguccacccagaacgccaucaacggcaucaccaacaaggucaacagcgugaucgagaagaugaacacccaguucacggccgugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacagcaacgucaagaaccuguacgagaaggugaagucccagcucaagaacaacgcgaaggagaucggcaacgggugcuucgaguucuaccacaagugcaacaacgagugcauggagucggugaagaacggcaccuacgacuaccccaaguacuccgaggagagcaagcugaaccgggagaagaucgacggggucaagcuggagagcaugggcguguaccagauccucgccaucuacuccacgguggccagcucccugguccugcucgugagccugggcgccaucuccuucuggaugugcagcaacgggucccugcagugccgcaucugcaucuga

SEQ ID NO: 9137 - RNA, 1701 nt, Artificial Sequence
  derived and/or modified CDS sequence (AUadapt) from InfluenzaA__AFJ78320__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 9138 - RNA, 1698 nt, Artificial Sequence
  derived and/or modified CDS sequence (AUadapt) from InfluenzaA__AFJ78331__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgugaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 9139 - RNA, 1698 nt, Artificial Sequence; identical to SEQ ID NO: 9138
  derived and/or modified CDS sequence (AUadapt) from InfluenzaA__AFJ78342__HA

SEQ ID NO: 9140 - RNA, 1698 nt, Artificial Sequence; identical to SEQ ID NO: 9138
  derived and/or modified CDS sequence (AUadapt) from InfluenzaA__AFJ78353__HA

SEQ ID NO: 9141 - RNA, 1698 nt, Artificial Sequence
  derived and/or modified CDS sequence (AUadapt) from InfluenzaA__AFJ78364__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugucguccgugagcuccuucgagcgguucgagaucuucccgaaggagagcuccuggcccaaccacaccgugaccggggucagcgccuccugcucgcacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggaccagcgggccaucuaccacacggagaacgccuacguguccgucgugagcucccacuacaaccgccgguucaccccggagaucgccaagcgccccaaggugcggaaccaggagggccgcaucaacuacuacuggacccugcuggagcccggcgacaccaucaucuucgaggcgaacgggaaccucaucgcccccugguacgccuucgcccugucgcggggcuucggguccggcaucaucacgagcaacgccccgauggacgagugcgacgcgaagugccagacgccccagggcgccaucaacuccagccugcccuuccagaacguccaccccaucaccaucggggagugcccgaaguacgugcgcuccgccaagcuccggauggugaccggccugcgcaacauccccagcauccagucccgggggcuguucggcgccaucgccggguucaucgagggcggcuggaccgggaugaucgacggcugguacggguaccaccaccagaacgagcagggcucgggguacgcggccgaccagaaguccacccagaacgccaucaacggcaucaccaacaaggucaacagcgugaucgagaagaugaacacccaguucacggccgugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacuccaacgucaagaaccuguacgagaaggucaagagccagcucaagaacaacgcgaaggagaucggcaacgggugcuucgaguucuaccacaagugcaacaacgagugcauggaguccgugaagaacggcaccuacgacuaccccaaguacagcgaggaguccaagcugaaccgggagaagaucgacggggugaagcuggagucgaugggcguguaccagauccucgccaucuacagcacgguggccuccagccugguccugcucgugucccugggcgccaucagcuucuggaugugcuccaacgggagccugcagugccgcaucugcaucuga

SEQ ID NO: 9142 - RNA, 1698 nt, Artificial Sequence
  derived and/or modified CDS sequence (AUadapt) from InfluenzaA__AFJ78375__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccaucaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucguggagacccccaaccccgagaacggcacgugcuaccccggccacuucgccgacuacgaggagcugcgcgagcagcucuccagcgucuccucguucgagcgguucgagaucuucccgaaggaguccagcuggcccaaccacaccgugaccgggguguccgccagcugcucccacaacggcaagagcuccuucuaccgcaaccugcuguggcucaccgagaagaacgggcuguaccccaaccugagcaaguccuacgucaacaacaaggagaaggaggugcucgugcuguggggcguccaccaccccucgaacaucggggaccagcgggccaucuaccacacggagaacgccuacgugagcguggucuccagccacuacucccgccgguucaccccggagaucgugaagcgccccaaggugcgggaccaggagggccgcaucaacuacuacuggacccugcucgagcccggcgacaccaucaucuucgaggccaacgggaaccugaucgcgcccugguacgccuucgcccugagccggggcuucggguccggcaucaucacgagcaacgccccgauggacgagugcgacgccaagugccagacgccccagggcgcgaucaacuccucgcuccccuuccagaacguccaccccgugaccaucggggagugcccgaaguacgugcgcuccgccaagcugcggauggucaccggccugcgcaacauccccagcauccagucccggggccucuucggggccaucgccggguucaucgagggcggcuggaccgggaugaucgacggcugguacggguaccaccaccagaacgagcagggcagcggguacgccgcggaccagaaguccacccagaacgccaucaacggcaucaccaacaaggugaacagcaucaucgagaagaugaacacccaguucacggccgugggcaaggaguucaacaagcuggagcgccggauggagaaccugaacaagaaggucgacgacggguuccucgacaucuggaccuacaacgccgagcugcuggugcuccuggagaacgagcgcacccuggacuuccacgacuccaacgucaagaaccucuacgagaaggucaagagccagcugaagaacaacgccaaggagaucggcaacgggugcuucgaguucuaccacaagugcaacaacgagugcauggaguccgugaagaacggcaccuacgacuaccccaaguacucggaggaguccaagcugaaccgggagaagaucgacggggugaagcucgagagcaugggcguguaccagauccuggcgaucuacagcacgguggccuccagccugguccuccuggugucccugggcgccaucagcuucuggaugugcuccaacgggagccuccagugccgcaucugcaucuga

SEQ ID NO: 9143 - RNA, 1698 nt, Artificial Sequence; identical to SEQ ID NO: 1630
  derived and/or modified CDS sequence (AUadapt) from InfluenzaA__AFJ78386__HA

SEQ ID NO: 9144 - RNA, 1698 nt, Artificial Sequence; identical to SEQ ID NO: 1630
  derived and/or modified CDS sequence (AUadapt) from InfluenzaA__AFJ78397__HA

SEQ ID NO: 9145 - RNA, 1698 nt, Artificial Sequence; identical to SEQ ID NO: 8322
  derived and/or modified CDS sequence (AUadapt) from InfluenzaA__AFJ78408__HA

SEQ ID NO: 9146 - RNA, 1698 nt, Artificial Sequence
  derived and/or modified CDS sequence (AUadapt) from InfluenzaA__AFJ78419__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccucgguguccagcuucgagcgguucgagaucuucccgaaggaguccagcuggcccaaccacacggucaccgggguguccgccagcugcucccacaacggcaagucguccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgcgcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccgucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 9147 - RNA, 1698 nt, Artificial Sequence
  derived and/or modified CDS sequence (AUadapt) from InfluenzaA__AFJ78430__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaaccccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgggcccuguaccacaccgagaacgccuacgugucggucgugagcucccacuacagccgcaaguucacgcccgagaucgccaagcggcccaaggugcgcgaccaggagggccggaucaacuacuacuggacccuccuggggcccggcgacaccaucaucuucgaggcgaacgggaaccugaucgccccgcgcuacgccuucgcccucucccggggcuucggcagcgggaucaucaacuccaacgcccccauggacgagugcgacgcgaagugccagacgccccagggcgccaucaacucgucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucacgaacaaggugaacucggucaucgagaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgggagaagaucgacggcgugaagcucgaguccaugggggucuaccagauccuggccaucuacucgaccguggccagcucccuggugcuccuggucagccugggcgccaucuccuucuggaugugcagcaacgggucccuccagugccgcaucugcaucuga

SEQ ID NO: 9148 - RNA, 1698 nt, Artificial Sequence
  derived and/or modified CDS sequence (AUadapt) from InfluenzaA__AFJ78441__HA
augaaggugaagcugaugguccuccugugcaccuucaccgccacguacgccgacaccaucugcaucggcuaccacgcgaacaacucgaccgacaccguggacacggugcuggagaagaacgucaccgugacccacuccgugaaccuccuggaggacagccacaacgggaagcugugccuccugaagggcaucgcgccccugcagcucgggaacugcuccgucgccggcuggauccuggggaacccggagugcgagcugcucaucagccgcgaguccuggucguacaucguggagaagcccaaccccgagaacgggaccugcuaccccggccacuucgccgacuacgaggagcugcgggagcagcuguccagcguguccagcuucgagcgcuucgagaucuucccgaaggaguccagcuggcccaaccacacggucaccgggguguccgccucgugcucccacaacggcaagagcuccuucuacaagaaccuccuguggcugaccgggaagaacggccucuaccccaaccugagcaaguccuacgccaacaacaaggagaaggaggugcugguccucuggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccugcucgagcccggggacaccaucaucuucgaggcgaacggcaaccugaucgccccgcgguacgccuucgcccugucccgcggguucggcagcggcaucaucaacuccaacgcccccauggacgagugcgacgcgaagugccagacgccccagggggccaucaacucgucccuccccuuccagaacguccacccggugaccaucggcgagugccccaaguacgugcggagcgccaagcugcgcauggucaccgggcugcggaacauccccuccauccagagccgcggccucuucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggacaaggaguucaacaagcuggagcggcgcauggagaaccugaacaagaaggucgacgacggguucaucgacaucuggaccuacaacgccgagcuccuggugcugcucgagaacgagcggacgcuggacuuccacgacagcaacgugaagaaccuguacgagaaggucaagucccagcucaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcuggaguccaugggcgucuaccagauccucgccaucuacucgaccguggccagcucccuggugcugcucgucagccugggcgccaucuccuucuggaugugcagcaacgggucccugcagugccggaucugcaucuga

SEQ ID NO: 9149 - RNA, 1698 nt, Artificial Sequence
  derived and/or modified CDS sequence (AUadapt) from InfluenzaA__AFJ78452__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcaagucguccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacucgcgcaaguucauccccgagaucgccaagcggcccaaggugcgcgaccaggagggccggaucaacuacuacuggacgcuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggacguacgacuaccccaaguacuccgaggagucgaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 9150 - RNA, 1698 nt, Artificial Sequence
  derived and/or modified CDS sequence (AUadapt) from InfluenzaA__AFJ78463__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugggcaagagcuacgccaacaacaaggagaaggaggugcucguccuguggggcgugcaccacccgcccaacaucggcgaccagaaggcccuguaccacaccgagaacgccuacguguccgucgugucgagccacuacucccgcaaguucauccccgagaucgccaagcggcccaaggugcgcgaccaggaggggcggaucaacuacuacuggacgcuccuggagcccggcgacaccaucaucuucgaggcgaacgggaaccugaucgccccgcgcuacgccuucgcccucagccggggcuucggcuccgggaucaucaacagcaacgcccccauggacgagugcgacgcgaagugccagacgccccagggcgccaucaacuccucgcugcccuuccagaacguccacccggugaccaucggggagugccccaaguacgugcgcuccgccaagcugcggauggucaccggccuccgcaacauccccagcauccagucccgggggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacucggucaucgagaagaugaacacgcaguucaccgccgugggcaaggaguucaacaagcuggagcgccggauggagaaccucaacaagaaggucgacgacggguucaucgacaucuggaccuacaacgccgagcugcuggugcuccuggagaacgagcgcacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcacguacgacuaccccaaguacagcgaggaguccaagcugaaccgggagaagaucgacggcgugaagcucgagagcaugggggucuaccagauccuggccaucuacuccaccguggccucgagccuggugcuccuggucucccugggcgccaucagcuucuggaugugcuccaacgggagccuccagugccgcaucugcaucuga

SEQ ID NO: 9151 - RNA, 1698 nt, Artificial Sequence
  derived and/or modified CDS sequence (AUadapt) from InfluenzaA__AFJ78474__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccucgguguccagcuucgagcgcuucgagaucuucccgaaggaguccagcuggcccaaccacacggucaccgggguguccgccagcugcuccuacaacggcaagucguccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgggcccuguaccacaccgagaacgccuacgugagcgucgugagcucccacuacucgcgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 9152 - RNA, 1698 nt, Artificial Sequence
  derived and/or modified CDS sequence (AUadapt) from InfluenzaA__AFJ78485__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccucguggcccaaccacacgaccaccggggucuccgccagcugcucccacaacggcgagagcuccuucuacaagaaccugcuguggcucaccgggaagaacggccuguaccccaaccugucgaaguccuacgccaacaacaaggagaaggaggugcucgugcuguggggcguccaccacccgcccaacaucggcgaccagcgggcccuguaccacacggagaacgccuacgugagcguggucagcucccacuacucgcgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcucggccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggaggacggcuucaucgacaucuggacguacaacgccgagcugcugguccuccuggagaacgagcgcacccuggacuuccacgacucgaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggccaucuacucgaccgucgccagcucccuggugcuccuggugagccugggggccaucuccuucuggaugugcagcaacggcucccuccagugccgcaucugcaucuga

SEQ ID NO: 9153 - RNA, 1698 nt, Artificial Sequence
  derived and/or modified CDS sequence (AUadapt) from InfluenzaA__AFJ78496__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccucguggcccaaccacacgaccaccggggucuccgccagcugcucccacaacggcgagagcuccuucuacaagaaccugcuguggcucaccgggaagaacggccuguaccccaaccugucgaaguccuacgccaacaacaaggagaaggaggugcucgugcuguggggcguccaccacccgcccaacaucggcggccagcgggcccuguaccacacggagaacgccuacgugagcguggucagcucccacuacucgcgcaaguucacccccgagaucgccaagcggcccaaggugcgcgaccaggaggggcggaucaacuacuacuggacccuccuggagcccggcgacaccaucaucuucgaggcgaacgggaaccugaucgccccgcgcuacgccuucgcccucucccggggcuucggcagcgggaucaucaacuccaacgcccccauggacgagugcgacgcgaagugccagacgccccagggcgccaucaacagcucccugcccuuccagaacgugcacccggucaccaucggggagugccccaaguacgugcgcucggccaagcugcggauggugaccggccuccgcaacauccccuccauccagagccgggggcuguucggcgccaucgccggcuucaucgagggcggguggaccgggauggucgacggcugguacggguaccaccaccagaacgagcagggcuccggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacucgaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgggagaagaucgacggcgugaagcucgaguccauggggguguaccagauccuggccaucuacucgaccgucgccagcucccuggugcuccuggugagccugggcgccaucuccuucuggaugugcagcaacgggucccuccagugccgcaucugcaucuga

SEQ ID NO: 9154 - RNA, 1698 nt, Artificial Sequence
  derived and/or modified CDS sequence (AUadapt) from InfluenzaA__AFJ78518__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccucguggcccaaccacacgaccaccggggucuccgccagcugcucccacaacggcgagagcuccuucuacaagaaccugcuguggcucaccgggaagaacggccuguaccccaaccugucgaaguccuacgccaacaacaaggagaaggaggugcucgugcuguggggcguccaccacccgcccaacaucggcgaccagcgggcccuguaccacacggagaacgccuacgugagcguggucagcucccacuacucgcgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcucggccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacucgaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggccaucuacucgaccgucgccagcucccuggugcuccuggugagccugggggccaucuccuucuggaugugcagcaacggcucccuccagugccgcaucugcaucuga

SEQ ID NO: 9155 - RNA, 1698 nt, Artificial Sequence
  derived and/or modified CDS sequence (AUadapt) from InfluenzaA__AFJ78529__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucucguccgugagcuccuucgagcgcuucgagaucuucccgaaggagagcuccuggcccaaccacacggucaccggggugagcgccuccugcucgcacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugucgagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgcccccauggacgagugcgacgccaagugccagacgccccagggggcgaucaacuccucgcugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacuccaacgucaagaaccucuacgagaaggugaagaaccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgucaagcucgagagcaugggcguguaccagauccuggcgaucuacuccaccguggccucgagccugguccuccuggugucccugggggccaucagcuucuggaugugcuccaacggcagccuccagugccggaucugcaucuga

SEQ ID NO: 9156 - RNA, 1698 nt, Artificial Sequence; identical to SEQ ID NO: 9155
  derived and/or modified CDS sequence (AUadapt) from InfluenzaA__AFJ78540__HA

SEQ ID NO: 9157 - RNA, 1698 nt, Artificial Sequence; identical to SEQ ID NO: 9155
  derived and/or modified CDS sequence (AUadapt) from InfluenzaA__AFJ78551__HA

SEQ ID NO: 9158 - RNA, 1698 nt, Artificial Sequence
  derived and/or modified CDS sequence (AUadapt) from InfluenzaA__AFJ78562__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucucguccgugagcuccuucgagcgcuucgagaucuucccgaaggagagcuccuggcccaaccacacggucaccggggugagcgccuccugcucgcacaacggcgaguccagcuucuacaagaaccugcuguggcucaccgggaagaacggccuguaccccacccuguccaagagcuacgccaacaacaaggagaaggaggugcucguccuguggggcgugcaccacccgcccaacaucggcgaccagaugacgcuguaccacaaggagaacgccuacguguccgucgugucgagccacuacucccggaaguucacccccgagaucgccaagcgccucaaggugcgggaccaggagggccgcaucaacuacuacuggacccugcuggagcccggggacaccaucaucuucgaggccaacggcaaccucaucgcgccccgguacgccuucgcccugagccgcgggcugggcuccggcaucaucaacagcaacgccccgauggacgagugcgacgccaagugccagacgccccagggggcgaucaacuccucgcuccccuuccagaacguccaccccgugaccaucggcgagugcccgaaguacgugcgguccgccaagcugcgcauggucaccgggcugcggaacauccccagcauccagucccgcggccucuucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccugaacaagaaggucgacgacggcuucaucgacguguggacguacaacgccgagcuccuggugcugcucgagaacgagcggacccuggacuuccacgacuccaacgucaagaaccuguacgagaaggugaagaaccagcucaagaacaacgccaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgucaagcuggagagcaugggcguguaccagauccucgcgaucuacuccaccguggccucgagccugguccugcucgugucccugggggccaucagcuucuggaugugcuccaacggcagccugcagugccggaucugcaucuga

SEQ ID NO: 9159 - RNA, 1698 nt, Artificial Sequence
  derived and/or modified CDS sequence (AUadapt) from InfluenzaA__AFJ78573__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucucguccgugagcuccuucgagcgcuucgagaucuucccgaaggagagcuccuggcccaaccacacggucaccggggugagcgccuccugcucgcacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugucgagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgccuccauggacgagugcgacgccaagugccagacgccccagggggcgaucaacucgucccugcccuuccagaacguccaccccgugaccaucggcgagugcccgaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaggcgaagcugucccgcgagaagaucgacggcgucaagcucgagagcaugggcguguaccagauccuggccaucuacuccaccguggccucgagccugguccuccuggugucccugggggccaucagcuucuggaugugcuccaacggcagccuccagugccggaucugcaucuga

SEQ ID NO: 9160 - RNA, 1698 nt, Artificial Sequence
  derived and/or modified CDS sequence (AUadapt) from InfluenzaA__AFJ78584__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccggcguguccgccagcugcucccacaacggcgagaacagcuucuaccgcaaccugcuguggcucacccggaagaacgggcuguaccccaaccuguccaagucguacgccaacaacaaggagaaggaggugcucguccuguggggcgugcaccacccgcccaacaucggggaccagaaggcccuguaccacaccgagaacgccuacguguccgucgugagcagccacuacucccgcaaguucacgcccgagaucgccaagcggcccaaggugcgcgaccaggagggccggaucaacuacuacuggacccuccuggagcccggcgacaccaucaucuucgaggcgaacgggaaccugaucgccccgcgcuacgccuucgcccucucgcggggcuucggguccggcaucaucaacagcaacgcccccauggacaagugcgacgcgaagugccagacgccccagggcgccaucaacuccagccugcccuuccagaacguccacccgguggccaucggggagugccccaaguacgugcgcuccgccaagcugcggauggucaccggccuccgcaacauccccucgauccagucccgggggcuguucggcgccaucgcgggguucaucgagggcggcuggaccgggaugguggacggcugguacggguaccaccaccagaacgagcagggcagcggguacgccgccgaccagaaguccacccagaacgccaucaacggcaucaccaacaaggugaacagcgucaucgagaagaugaacacgcaguucaccgccgugggcaaggaguucaacaagcuggagcgccggauggagaaccucaacaagaaggucgacgacggguucaucgacaucuggaccuacaacgcggagcugcuggugcuccuggagaacgagcgcacccuggacuuccacgacuccaacgugaagaaccucuacgagaaggucaagucgcagcugaagaacaacgccaaggagaucggcaacgggugcuucgaguucuaccacaagugcaacgacgagugcauggaguccgugaagaacggcacguacgacuaccccaaguacagcgaggaguccaagcugaaccgggagaagaucgacggggugaagcucgagagcaugggcgucuaccagauccuggccaucuacuccaccguggccucgagccuggugcuccuggucucccugggcgccaucagcuucuggaugugcuccaacgggagccuccagugccgcaucugcaucuga

SEQ ID NO: 9161 - RNA, 1698 nt, Artificial Sequence
  derived and/or modified CDS sequence (AUadapt) from InfluenzaA__AFJ78595__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaaccgggagaaggaggugcucguccuguggggcgugcaccacccgcccaacaucggcgaccagaaggcccuguaccacaccgagaacgccuacgugucggucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 9162 - RNA, 1698 nt, Artificial Sequence
  derived and/or modified CDS sequence (AUadapt) from InfluenzaA__AFJ78617__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacgacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucucggaccagaagacccuguaccacacggagaacgcccacguguccgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugucgaaggaguucaacaagcuggagcggcgcauggagaaccucaacaagaaggucgacgacggcuucaucgacaucuggacguacaacgccgagcugcuggugcuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggagagcaagcugaaccgcgagaagaucgacggcgugaagcucgaguccaugggggucuaccagauccuggcgaucuacucgaccguggccuccagccuggugcuccuggucucccugggcgccaucagcuucuggaugugcuccaacggcagccuccagugccggaucugcaucuga

SEQ ID NO: 9163 - RNA, 1698 nt, Artificial Sequence
  derived and/or modified CDS sequence (AUadapt) from InfluenzaA__AFJ78628__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucucguccgugagcuccuucgagcgcuucgagaucuucccgaaggagagcuccuggcccaaccacacggucaccggggugagcgccuccugcucgcacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcaaccagaugacccuguaccacaaggagaacgccuacguguccgucgugucgagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgcccccauggacgagugcgacgccaagugccagacgccccagggggcgaucaacuccucgcugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacuccaacgucaagaaccucuacgagaaggugaagaaccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgucaagcucgagagcaugggcguguaccagauccuggcgaucuacuccaccguggccucgagccugguccuccuggugucccugggggccaucagcuucuggaugugcuccaacggcagccuccagugccggaucugcaucuga

SEQ ID NO: 9164 - RNA, 1698 nt, Artificial Sequence
  derived and/or modified CDS sequence (AUadapt) from InfluenzaA__AFJ78639__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccagcaucagcaaccagaagacccuguaccacacggagaacgccuacguguccgucgugagcucccacuacucgcggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggugaagcucgagagcaugggcgucuaccagauccuggcgaucuacuccaccguggccagcucccuggugcuccuggucagccugggcgccaucuccuucuggaugugcagcaacgggucccuccagugccggaucugcaucuga

SEQ ID NO: 9165 - RNA, 1698 nt, Artificial Sequence; identical to SEQ ID NO: 9164
  derived and/or modified CDS sequence (AUadapt) from InfluenzaA__AFJ78650__HA

SEQ ID NO: 9166 - RNA, 1701 nt, Artificial Sequence; identical to SEQ ID NO: 116
  derived and/or modified CDS sequence (AUadapt) from InfluenzaA__AFJ78661__HA

SEQ ID NO: 9167 - RNA, 1701 nt, Artificial Sequence
  derived and/or modified CDS sequence (AUadapt) from InfluenzaA__AFJ78681__HA
augaaggccauccuggugguccuccuguacaccuucgccaccgugaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 9168 - RNA, 1701 nt, Artificial Sequence; identical to SEQ ID NO: 116
  derived and/or modified CDS sequence (AUadapt) from InfluenzaA__AFJ78691__HA

SEQ ID NO: 9169 - RNA, 1701 nt, Artificial Sequence; identical to SEQ ID NO: 116
  derived and/or modified CDS sequence (AUadapt) from InfluenzaA__AFJ78701__HA

SEQ ID NO: 9170 - RNA, 1701 nt, Artificial Sequence; identical to SEQ ID NO: 7442
  derived and/or modified CDS sequence (AUadapt) from InfluenzaA__AFJ78711__HA

SEQ ID NO: 9171 - RNA, 1701 nt, Artificial Sequence; identical to SEQ ID NO: 116
  derived and/or modified CDS sequence (AUadapt) from InfluenzaA__AFJ78721__HA

SEQ ID NO: 9172 - RNA, 1701 nt, Artificial Sequence
  derived and/or modified CDS sequence (AUadapt) from InfluenzaA__AFJ78731__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcuccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 9173 - RNA, 1701 nt, Artificial Sequence; identical to SEQ ID NO: 4078
  derived and/or modified CDS sequence (AUadapt) from InfluenzaA__AFJ78741__HA

SEQ ID NO: 9174 - RNA, 1701 nt, Artificial Sequence; identical to SEQ ID NO: 116
  derived and/or modified CDS sequence (AUadapt) from InfluenzaA__AFJ78751__HA

SEQ ID NO: 9175 - RNA, 1701 nt, Artificial Sequence; identical to SEQ ID NO: 116
  derived and/or modified CDS sequence (AUadapt) from InfluenzaA__AFJ78761__HA

SEQ ID NO: 9176 - RNA, 1701 nt, Artificial Sequence; identical to SEQ ID NO: 116
  derived and/or modified CDS sequence (AUadapt) from InfluenzaA__AFJ78771__HA

SEQ ID NO: 9177 - RNA, 1701 nt, Artificial Sequence; identical to SEQ ID NO: 116
  derived and/or modified CDS sequence (AUadapt) from InfluenzaA__AFJ78781__HA

SEQ ID NO: 9178 - RNA, 1701 nt, Artificial Sequence; identical to SEQ ID NO: 116
  derived and/or modified CDS sequence (AUadapt) from InfluenzaA__AFJ78791__HA

SEQ ID NO: 9179 - RNA, 1701 nt, Artificial Sequence; identical to SEQ ID NO: 116
  derived and/or modified CDS sequence (AUadapt) from InfluenzaA__AFJ78801__HA

SEQ ID NO: 9180 - RNA, 1701 nt, Artificial Sequence; identical to SEQ ID NO: 3775
  derived and/or modified CDS sequence (AUadapt) from InfluenzaA__AFJ78811__HA

SEQ ID NO: 9181 - RNA, 1701 nt, Artificial Sequence; identical to SEQ ID NO: 116
  derived and/or modified CDS sequence (AUadapt) from InfluenzaA__AFJ78821__HA

SEQ ID NO: 9182 - RNA, 1701 nt, Artificial Sequence; identical to SEQ ID NO: 116
  derived and/or modified CDS sequence (AUadapt) from InfluenzaA__AFJ78831__HA

SEQ ID NO: 9183 - RNA, 1701 nt, Artificial Sequence; identical to SEQ ID NO: 4112
  derived and/or modified CDS sequence (AUadapt) from InfluenzaA__AFJ78841__HA

SEQ ID NO: 9184 - RNA, 1701 nt, Artificial Sequence; identical to SEQ ID NO: 116
  derived and/or modified CDS sequence (AUadapt) from InfluenzaA__AFJ78851__HA

SEQ ID NO: 9185 - RNA, 1701 nt, Artificial Sequence
  derived and/or modified CDS sequence (AUadapt) from InfluenzaA__AFJ78861__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9186 - RNA, 1701 nt, Artificial Sequence
  derived and/or modified CDS sequence (AUadapt) from InfluenzaA__AFJ78881__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccagcuccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaagucguacaucaacgacaagggcaaggaggugcugguccucugggggauccaccaccccuccaccagcgcggaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcucgggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucaacggcgugaagcucgaguccacccgcaucuaccagauccuggccaucuacucgaccgcggccagcucccugguccucguggugucgcugggggccaucuccuucuggaugugcagcaacggcucccugcagugccggaucugcaucuga

SEQ ID NO: 9187 - RNA, 1701 nt, Artificial Sequence; identical to SEQ ID NO: 116
  derived and/or modified CDS sequence (AUadapt) from InfluenzaA__AFJ78891__HA

SEQ ID NO: 9188 - RNA, 1701 nt, Artificial Sequence; identical to SEQ ID NO: 116
  derived and/or modified CDS sequence (AUadapt) from InfluenzaA__AFJ78901__HA

SEQ ID NO: 9189 - RNA, 1701 nt, Artificial Sequence; identical to SEQ ID NO: 116
  derived and/or modified CDS sequence (AUadapt) from InfluenzaA__AFJ78911__HA

SEQ ID NO: 9190 - RNA, 1701 nt, Artificial Sequence; identical to SEQ ID NO: 116
  derived and/or modified CDS sequence (AUadapt) from InfluenzaA__AFJ78921__HA

SEQ ID NO: 9191 - RNA, 1701 nt, Artificial Sequence
  derived and/or modified CDS sequence (AUadapt) from InfluenzaA__AFJ97567__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccucgaccagcacggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucaccauggagcgcaacgccgggagcggcaucaucaucuccgacacccccgugcacgacugcaacaccacgugccagaccccgaagggcgccaucaacaccucguuccccuuccagaacauccaccccaucaccaucgggaagugccccaaguacgugaaguccacgaagcugcggcuggccaccggccuccgcaacgucccgagcauccagucccgggggcuguucggcgccaucgcgggguucaucgagggcggcuggaccgggaugguggacggcugguacggguaccaccaccagaacgagcagggcucgggguacgccgccgaccugaaguccacccagaacgccaucgacgagaucacgaacaaggugaacagcgucaucgagaagaugaacacccaguucaccgccgugggcaaggaguucaaccaccucgagaagcgcaucgagaaccugaacaagaaggucgacgacggcuuccuggacaucuggaccuacaacgcggagcuccuggugcugcucgagaacgagcggacgcuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacucgaccgucgccuccagccuggugcugguggucucgcucggggcgaucuccuucuggaugugcagcaacggcucccugcagugccggaucugcaucuga

SEQ ID NO: 9192 - RNA, 1701 nt, Artificial Sequence; identical to SEQ ID NO: 116
  derived and/or modified CDS sequence (AUadapt) from InfluenzaA__AFK14115__HA

SEQ ID NO: 9193 - RNA, 1701 nt, Artificial Sequence; identical to SEQ ID NO: 116
  derived and/or modified CDS sequence (AUadapt) from InfluenzaA__AFK14131__HA

SEQ ID NO: 9194 - RNA, 1701 nt, Artificial Sequence; identical to SEQ ID NO: 4596
  derived and/or modified CDS sequence (AUadapt) from InfluenzaA__AFK14139__HA

SEQ ID NO: 9195 - RNA, 1701 nt, Artificial Sequence
  derived and/or modified CDS sequence (AUadapt) from InfluenzaA__AFK14148__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 9196 - RNA, 1701 nt, Artificial Sequence; identical to SEQ ID NO: 4541
  derived and/or modified CDS sequence (AUadapt) from InfluenzaA__AFK14157__HA

SEQ ID NO: 9197 - RNA, 1701 nt, Artificial Sequence; identical to SEQ ID NO: 116
  derived and/or modified CDS sequence (AUadapt) from InfluenzaA__AFK14166__HA

SEQ ID NO: 9198 - RNA, 1701 nt, Artificial Sequence; identical to SEQ ID NO: 4242
  derived and/or modified CDS sequence (AUadapt) from InfluenzaA__AFK14175__HA

SEQ ID NO: 9199 - RNA, 1701 nt, Artificial Sequence; identical to SEQ ID NO: 5819
  derived and/or modified CDS sequence (AUadapt) from InfluenzaA__AFK14184__HA

SEQ ID NO: 9200 - RNA, 1701 nt, Artificial Sequence; identical to SEQ ID NO: 3267
  derived and/or modified CDS sequence (AUadapt) from InfluenzaA__AFK14193__HA

SEQ ID NO: 9201 - RNA, 1701 nt, Artificial Sequence; identical to SEQ ID NO: 4511
  derived and/or modified CDS sequence (AUadapt) from InfluenzaA__AFK14202__HA

SEQ ID NO: 9202 - RNA, 1701 nt, Artificial Sequence; identical to SEQ ID NO: 3267
  derived and/or modified CDS sequence (AUadapt) from InfluenzaA__AFK14211__HA

SEQ ID NO: 9203 - RNA, 1701 nt, Artificial Sequence
  derived and/or modified CDS sequence (AUadapt) from InfluenzaA__AFK14220__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgccucguccuucgagcgcuacgagaucuuccccaagaccagcuccuggcccaaccacgacucgaacaagggggugaccgccgccugcccgcacgcgggcgccaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacucggaggaggcgaagcugaaccgggaggagaucgacggcgugaagcucgaguccacccgcaucuaccagauccuggccaucuacucgaccguggccuccagccugguccucguggugucgcugggggccaucuccuucuggaugugcagcaacggcucccugcagugccggaucugcaucuga

SEQ ID NO: 9204 - RNA, 1701 nt, Artificial Sequence; identical to SEQ ID NO: 4541
  derived and/or modified CDS sequence (AUadapt) from InfluenzaA__AFK14229__HA

SEQ ID NO: 9205 - RNA, 1701 nt, Artificial Sequence; identical to SEQ ID NO: 7679
  derived and/or modified CDS sequence (AUadapt) from InfluenzaA__AFK14238__HA

SEQ ID NO: 9206 - RNA, 1701 nt, Artificial Sequence
  derived and/or modified CDS sequence (AUadapt) from InfluenzaA__AFK14247__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaugaacaccucccugcccuuccagaacauccaccccaucaccaucgggaagugccccaaguacgucaagucgaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 9207 - RNA, 1701 nt, Artificial Sequence
  derived and/or modified CDS sequence (AUadapt) from InfluenzaA__AFK14272__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugaccggcguggcgccccugcaccucgggaagugcgacaucgccggcuggauccuggggaacccggagugcgagucgcuguccaccgccagcuccuggucguacaucgucgagacguccagcuccgacaacgggaccugcuaccccggcgacuucaucgacuacgaggagcuccgcgagcagcugucguccgugagcuccuucgagcgguucgagaucuuccccaagaccucguccuggcccaaccacgacagcaacaagggcgugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgacguccgccgaccagcagagccuguaccagaacgccgacgccuacgucuucgugggcaccucccgcuacucgaagaaguucaagcccgagaucgccauccggccgaaggugcgcgaccaggagggccggaugaacuacuacuggacccuggucgagcccggggacaagaucaccuucgaggcgacgggcaaccucguggugccccgcuacgccuucgccauggagcggaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagucgaccaagcugcgccucgcgacgggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagucgacccagcacgcgaucgacgagaucaccaacaaggugaacuccgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 9208 - RNA, 1701 nt, Artificial Sequence; identical to SEQ ID NO: 3267
  derived and/or modified CDS sequence (AUadapt) from InfluenzaA__AFK14314__HA

SEQ ID NO: 9209 - RNA, 1701 nt, Artificial Sequence
  derived and/or modified CDS sequence (AUadapt) from InfluenzaA__AFK14323__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucaacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 9210 - RNA, 1701 nt, Artificial Sequence; identical to SEQ ID NO: 7679
  derived and/or modified CDS sequence (AUadapt) from InfluenzaA__AFK14332__HA

SEQ ID NO: 9211 - RNA, 1701 nt, Artificial Sequence
  derived and/or modified CDS sequence (AUadapt) from InfluenzaA__AFK14341__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagaagacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9212 - RNA, 1701 nt, Artificial Sequence; identical to SEQ ID NO: 4334
  derived and/or modified CDS sequence (AUadapt) from InfluenzaA__AFK14350__HA

SEQ ID NO: 9213 - RNA, 1701 nt, Artificial Sequence
  derived and/or modified CDS sequence (AUadapt) from InfluenzaA__AFK14358__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcgccugcuaccccggcgacuucaucgacuacgaggagcuccgggagcagcugucguccgugagcuccuucgagcgcuucgagaucuuccccaagacgucguccuggcccaaccacgacagcaacaagggggucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggagcaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagaagacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgcgaggagaucgacggcgugaagcucgagagcacccggaucuaccagauccuggccaucuacuccaccgucgccucgagccuggugcucguggucucccugggggccaucucguucuggaugugcuccaacggcagccugcagugccgcaucugcaucuga

SEQ ID NO: 9214 - RNA, 1701 nt, Artificial Sequence
  derived and/or modified CDS sequence (AUadapt) from InfluenzaA__AFK14395__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgagaacggcaugugcugcccccgggacuucaucgacuacgaggagcugcgcgagcagcucagcuccgugucguccuucgagcgguucgagaucuuccccaagacgagcuccuggcccaaccacgacucgaacaagggcgucaccgccgccugcccgcacgccggggcgaaguccuucuacaagaaccugaucuggcuggugaagaagggcaacagcuaccccaagcucuccaagucguacaucaacgacaaggggaaggaggugcugguccuguggggcauccaccaccccagcaccuccgccgaccagcagucgcucuaccagaacgccgacgccuacguguucgugggguccagccgcuacuccaagaaguucaagcccgagaucgccauccggccgaagguccgcgaccaggagggccggaugaacuacuacuggacccugguggagcccggcgacaagaucacguucgaggcgaccgggaaccugguggucccccgcuacgccuucgccauggagcggaacgccggcucggggaucaucaucuccgacacccccgugcacgacugcaacaccacgugccagaccccgaagggcgccaucaacaccagccuccccuuccagaacauccaccccaucaccaucggcaagugccccaaguacgugaaguccacgaagcugcgccuggcgaccgggcuccggaacgucccgucgauccagucccgcggccuguucggggccaucgccggcuucaucgagggcggguggaccggcaugguggacgggugguacggcuaccaccaccagaacgagcaggggagcggcuacgccgccgaccugaaguccacccagaacgcgaucgacgagaucacgaacaaggugaacucggucaucgagaagaugaacacccaguucaccgccguggggaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggagccagcucaagaacaacgccaaggaggugggcaacgggugcuucgaguucuaccacaagugcgacaacacgugcauggaguccgugaagaacggcaccuacgacuaccccaaguacucggaggaggccaagcugaaccgcgaggagaucgacggggucaagcuggaguccacccggaucuaccagauccucgcgaucuacagcaccgccgccucgucccuggugcugguggucagccucggcgccaucuccuucuggaugugcagcaacgggucccugcagugccgcaucugcaucuga

SEQ ID NO: 9215 - RNA, 1701 nt, Artificial Sequence
  derived and/or modified CDS sequence (AUadapt) from InfluenzaA__AFK14431__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuuccucgacuacgaggagcugcggaagcagcuguccucgguguccucguucgagcgcgucgagaucuuccccaagaccuccagcuggcccaaccacgacuccaacaagggggugaccgccgccugcccgcacgccggcgccaagucguucuacaagaaccucaucuggcuggugaagaaggggaacuccuaccccaagcugagcaaguccuacaucaacgacaagggcaaggagguccucgugcugugggggauccaccaccccucgaccagcgccgaccagcagucccuguaccagaacgccgacgccuacguguucgucggcacgucgcgguacuccaagaaguucaagcccgagaucgccauccgcccgaaggugcgggaccaggagggccgcaugaacuacuacuggacccucguggagcccggggacaagaucaccuucgaggcgaccggcaaccuggucgugccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcuccggcuggcgaccggccugcgcaacgugccgucgauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggucaacucggugaucgagaagaugaacacccaguucacggccgucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacuccaacgucaagaaccuguacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggcgaucuacucgaccguggccuccagccucgugcuggucgugucgcugggggccaucuccuucuggaugugcagcaacggcucccuccagugccggaucugcaucuga

SEQ ID NO: 9216 - RNA, 1701 nt, Artificial Sequence; identical to SEQ ID NO: 116
  derived and/or modified CDS sequence (AUadapt) from InfluenzaA__AFK14456__HA

SEQ ID NO: 9217 - RNA, 1701 nt, Artificial Sequence; identical to SEQ ID NO: 116
  derived and/or modified CDS sequence (AUadapt) from InfluenzaA__AFK14465__HA

SEQ ID NO: 9218 - RNA, 1701 nt, Artificial Sequence
  derived and/or modified CDS sequence (AUadapt) from InfluenzaA__AFK14536__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuacuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagcacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 9219 - RNA, 1701 nt, Artificial Sequence; identical to SEQ ID NO: 116
  derived and/or modified CDS sequence (AUadapt) from InfluenzaA__AFK14571__HA

SEQ ID NO: 9220 - RNA, 1701 nt, Artificial Sequence; identical to SEQ ID NO: 7423
  derived and/or modified CDS sequence (AUadapt) from InfluenzaA__AFK14586__HA

SEQ ID NO: 9221 - RNA, 1701 nt, Artificial Sequence
  derived and/or modified CDS sequence (AUadapt) from InfluenzaA__AFK14595__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccgaagugcgagucgcuguccaccgccagcuccuggucguacaucggcgagaccuccagcuccaacaacggcacgugcuaccccgggaacuucaucgacuucgaggagcucaagaagcagcugucguccgugagcuccuucgagcgcuucgagaucuuccccaagaccucguccuggcccaaccacgacagcaacaagggcgugaccgccgccugcccgcacgccggggcgaaguccuucuacaagaaccugaucuggcucgucaagaagggcaacucguaccccaagcuguccaagagcuacaucaacgacaaggggaaggaggugcuggugcucuggggcauccaccaccccucgaccuccgccgaccagcagagccuguaccagaacgccgacgccuacgucuucgugggcacgucccgguacucgaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 9222 - RNA, 1701 nt, Artificial Sequence; identical to SEQ ID NO: 7423
  derived and/or modified CDS sequence (AUadapt) from InfluenzaA__AFK14612__HA

SEQ ID NO: 9223 - RNA, 1701 nt, Artificial Sequence; identical to SEQ ID NO: 116
  derived and/or modified CDS sequence (AUadapt) from InfluenzaA__AFK14621__HA

SEQ ID NO: 9224 - RNA, 1701 nt, Artificial Sequence
  derived and/or modified CDS sequence (AUadapt) from InfluenzaA__AFK14630__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgacccgggccgaccugcaguccaucaaccagaacgccgacgccuacguguucgugggcacgucgcgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 9225 - RNA, 1701 nt, Artificial Sequence
  derived and/or modified CDS sequence (AUadapt) from InfluenzaA__AFK14639__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcgggcagcucaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcuggagagcacccgcaucuaccagauccucgcgaucuacuccaccgucgccucgagccuggugcugguggucucccucggcgccaucucguucuggaugugcuccaacggcagccugcagugccggaucugcaucuga

SEQ ID NO: 9226 - RNA, 1701 nt, Artificial Sequence; identical to SEQ ID NO: 116
  derived and/or modified CDS sequence (AUadapt) from InfluenzaA__AFK14661__HA

SEQ ID NO: 9227 - RNA, 1701 nt, Artificial Sequence; identical to SEQ ID NO: 7423
  derived and/or modified CDS sequence (AUadapt) from InfluenzaA__AFK14670__HA

SEQ ID NO: 9228 - RNA, 1701 nt, Artificial Sequence; identical to SEQ ID NO: 7423
  derived and/or modified CDS sequence (AUadapt) from InfluenzaA__AFK14678__HA

SEQ ID NO: 9229 - RNA, 1701 nt, Artificial Sequence
  derived and/or modified CDS sequence (AUadapt) from InfluenzaA__AFK14688__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucauccacgacgaggagcuccggaagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaaggccggguccggcaucaucauccuggacacgcccgugcacgacuggaacacgaccugcgagaccccgaagggcgccgugaacaccucgcugcccuuccagaacauccaccccaucaccaucgggaagugccccaaguacgucaaguccaccaagcuccggcuggcgaccggccugcgcaacgugccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacgagaucaccaacaaggucaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacuccaacgucaagaaccuguacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggcgaucuacucgaccguggccuccagccucgugcuggucgugucgcugggggccaucuccuucuggaugugcagcaacggcucccuccagugccggaucugcaucuga

SEQ ID NO: 9230 - RNA, 1701 nt, Artificial Sequence; identical to SEQ ID NO: 7423
  derived and/or modified CDS sequence (AUadapt) from InfluenzaA__AFK14697__HA

SEQ ID NO: 9231 - RNA, 1701 nt, Artificial Sequence; identical to SEQ ID NO: 7423
  derived and/or modified CDS sequence (AUadapt) from InfluenzaA__AFK14713__HA

SEQ ID NO: 9232 - RNA, 1701 nt, Artificial Sequence; identical to SEQ ID NO: 7423
  derived and/or modified CDS sequence (AUadapt) from InfluenzaA__AFK14722__HA

SEQ ID NO: 9233 - RNA, 1701 nt, Artificial Sequence
  derived and/or modified CDS sequence (AUadapt) from InfluenzaA__AFK14731__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccggaagcagcugucguccgugagcuccuucgagcgcgucgagaucuuccccaagaccucguccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaagggcgccgucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 9234 - RNA, 1701 nt, Artificial Sequence; identical to SEQ ID NO: 7423
  derived and/or modified CDS sequence (AUadapt) from InfluenzaA__AFK14740__HA

SEQ ID NO: 9235 - RNA, 1701 nt, Artificial Sequence; identical to SEQ ID NO: 7423
  derived and/or modified CDS sequence (AUadapt) from InfluenzaA__AFK14749__HA

SEQ ID NO: 9236 - RNA, 1701 nt, Artificial Sequence; identical to SEQ ID NO: 7423
  derived and/or modified CDS sequence (AUadapt) from InfluenzaA__AFK14756__HA

SEQ ID NO: 9237 - RNA, 1701 nt, Artificial Sequence; identical to SEQ ID NO: 7423
  derived and/or modified CDS sequence (AUadapt) from InfluenzaA__AFK14764__HA

SEQ ID NO: 9238 - RNA, 1701 nt, Artificial Sequence
  derived and/or modified CDS sequence (AUadapt) from InfluenzaA__AFK14779__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagucgcuguccaccgccagcuccuggucguacaucguggagaccuccagcuccgacaacggcacgugcuaccccgggaacuucaucgacuacgaggagcuccgcgagcagcugucguccgugagcuccuucgagcgguucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgcuacucgaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 9239 - RNA, 1701 nt, Artificial Sequence
  derived and/or modified CDS sequence (AUadapt) from InfluenzaA__AFK14788__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcuggugaagaaggggaacagcuaccccaagcuccggaaguccuacaucaacgacaagggcaaggaggugcugguccugugggggauccaccaccccucgaccagcgccgaccagcagucccucuaccagaacgccgacgccuacguguucgugggcucgucccgcuacagcaagaaguucaagcccgagaucgccauccggccgaagguccgcgaccaggagggccggaugaacuacuacuggacgcugguggagcccggggacaagaucaccuucgaggcgaccggcaaccugguggucccccgcuacgccuucgccauggagcggaacgccggguccggcaucaucaucucggacacccccgugcacgacugcaacacgaccugccagaccccgaagggcgccaucaacaccucccuccccuuccagaacauccaccccaucacgaucgggaagugccccaaguacgucaagagcaccaagcugcgccuggcgaccggccuccggaacgugccguccauccagucgcgcgggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcggaucgagaaccugaacaagaaggucgacgacggcuuccuggacaucuggacguacaacgccgagcuccuggugcugcucgagaacgagcgcacccuggacuaccacgacagcaacgugaagaaccuguacgagaagguccggucccagcucaagaacaacgccaaggagguggggaacggcugcuucgaguucuaccacaagugcgacaacacgugcauggagucggugaagaacgggaccuacgacuaccccaaguacuccgaggaggccaagcugaaccgcgaggagaucgacggcgucaagcuggagagcacccggaucuaccagauccucgcgaucuacuccaccgccgccucgagccuggugcugguggucucccucggggccaucucguucuggaugugcuccaacggcagccugcagugccgcaucugcaucuga

SEQ ID NO: 9240 - RNA, 1701 nt, Artificial Sequence
  derived and/or modified CDS sequence (AUadapt) from InfluenzaA__AFK14798__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccggaagcagcugucguccgugagcuccuucgagcgcgucgagaucuuccccaagaccucguccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaacggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 9241 - RNA, 1701 nt, Artificial Sequence
  derived and/or modified CDS sequence (AUadapt) from InfluenzaA__AFK14814__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuacgagcgcuacgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9242 - RNA, 1701 nt, Artificial Sequence
  derived and/or modified CDS sequence (AUadapt) from InfluenzaA__AFK14831__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucucggacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaagucguacaucaacgacaagggcaaggaggugcugguccucugggggauccaccaccccuccaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccagcucccuggugcucguggucucgcugggggccaucuccuucuggaugugcagcaacggcucccugcagugccggaucugcaucuga

SEQ ID NO: 9243 - RNA, 1701 nt, Artificial Sequence; identical to SEQ ID NO: 116
  derived and/or modified CDS sequence (AUadapt) from InfluenzaA__AFK14839__HA

SEQ ID NO: 9244 - RNA, 1701 nt, Artificial Sequence
  derived and/or modified CDS sequence (AUadapt) from InfluenzaA__AFK14847__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgccucguccuucgagcgcuacgagaucuuccccaagaccagcuccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagucgaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagucgacccgcaucuaccagauccuggccaucuacuccaccguggccucgagccugguccucguggugucccugggggccaucucguucuggaugugcuccaacggcagccugcagugccggaucugcaucuga

SEQ ID NO: 9245 - RNA, 1701 nt, Artificial Sequence; identical to SEQ ID NO: 7423
  derived and/or modified CDS sequence (AUadapt) from InfluenzaA__AFK14868__HA

SEQ ID NO: 9246 - RNA, 1701 nt, Artificial Sequence; identical to SEQ ID NO: 4078
  derived and/or modified CDS sequence (AUadapt) from InfluenzaA__AFK14884__HA

SEQ ID NO: 9247 - RNA, 1701 nt, Artificial Sequence; identical to SEQ ID NO: 4078
  derived and/or modified CDS sequence (AUadapt) from InfluenzaA__AFK14892__HA

SEQ ID NO: 9248 - RNA, 1701 nt, Artificial Sequence; identical to SEQ ID NO: 4078
  derived and/or modified CDS sequence (AUadapt) from InfluenzaA__AFK14901__HA

SEQ ID NO: 9249 - RNA, 1701 nt, Artificial Sequence; identical to SEQ ID NO: 4078
  derived and/or modified CDS sequence (AUadapt) from InfluenzaA__AFK14910__HA

SEQ ID NO: 9250 - RNA, 1701 nt, Artificial Sequence; identical to SEQ ID NO: 116
  derived and/or modified CDS sequence (AUadapt) from InfluenzaA__AFK14919__HA

SEQ ID NO: 9251 - RNA, 1701 nt, Artificial Sequence; identical to SEQ ID NO: 116
  derived and/or modified CDS sequence (AUadapt) from InfluenzaA__AFK14929__HA

SEQ ID NO: 9252 - RNA, 1701 nt, Artificial Sequence; identical to SEQ ID NO: 8431
  derived and/or modified CDS sequence (AUadapt) from InfluenzaA__AFK25599__HA

SEQ ID NO: 9253 - RNA, 1701 nt, Artificial Sequence
  derived and/or modified CDS sequence (AUadapt) from InfluenzaA__AFK25601__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgugacccugucgaccgccuccagcugguccuacaucguggagacgucguccucggacaacgggaccugcuaccccggcgacuucaucgacuacgaggagcuccgggagcagcuguccagcgucuccucguucgagcgcuucgagaucuuccccaagaccuccucguggcccaaccacgacuccaacaagggcgugaccgccgccugcccgcacgccggcgcgaagggguucuacaagaaccugaucuggcucgugaagaagggcaacagcuaccccaagcuguccaagucguacaucaacgacaaggggaaggagguccuggugcucuggggcauccaccaccccuccacgaccgccgaccagcagucgcuguaccagaacgccgacaccuacguguucgucggcaccagccgguacuccaagaaguucaagcccgagaucgccauccgcccgaaggugcgggaccaggaggggcgcaugaacuacuacuggacgcugguggagcccggcgacaagaucaccuucgaggccaccgggaaccucgucgugccccgguacgcguucgccauggagcgcgacgccggcucgggcaucaucaucuccgacacccccgugcacgacugcaacacgaccugccagaccccgaagggggccaucaacaccucgcugcccuuccagaacauccaccccaucacgaucggcaagugccccaaguacgucaaguccaccaagcugcggcucgccaccgggcugcgcaacgugccgagcauccagucccggggccuguucggggcgaucgccggcuucaucgagggcggguggaccggcaugguggacgggugguacggcuaccaccaccagaacgagcaggggucgggcuacgccgccgaccucaaguccacgcagaacgccaucgacaagaucaccaacaaggucaacucggugaucgagaagaugaacacccaguucaccgcggucggcaaggaguucaaccaccuggagaagcgcaucgagaaccugaacaagaagguggacgacggguuccucgacaucuggacguacaacgccgagcugcuggugcuccuggagaacgagcggacccuggacuaccacgacuccaacgucaagaaccucuacgagaaggugcgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagucgacccgcaucuaccagauccuggccaucuacuccaccgcggccucgucccuggugcucguggucagccugggcgccaucuccuucuggaugugcucgaacggcagccugcagugccggaucugcaucuga

SEQ ID NO: 9254 - RNA, 1701 nt, Artificial Sequence; identical to SEQ ID NO: 8431
  derived and/or modified CDS sequence (AUadapt) from InfluenzaA__AFK25603__HA

SEQ ID NO: 9255 - RNA, 1701 nt, Artificial Sequence
  derived and/or modified CDS sequence (AUadapt) from InfluenzaA__AFK25605__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccagcuucgagcgcuucgagaucuuccccaagaccuccucguggcccaaccacgacuccaacaagggcgucaccgccgccugcccgcacgccggcgcgaagggguucuacaagaaccugaucuggcucgugaagaagggcaacucguaccccaagcuguccaagagcuacaucaacgacaaggggaaggaggugcugguccucuggggcauccaccaccccuccacgaccgccgaccagcagucgcuguaccagaacgccgacaccuacguguucgugggcaccucgcgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcucgggcaucaucaucuccgacacccccgugcacgacugcaacacgaccugccagaccccgaagggggccaucaacaccagccugcccuuccagaacauccaccccaucacgaucggcaagugccccaaguacgugcgguccaccaagcugcgccucgccaccgggcugcggaacgucccgucgauccagucccgcggccuguucggggcgaucgccggcuucaucgagggcggguggaccggcaugguggacgggugguacggcuaccaccaccagaacgagcaggggucgggcuacgccgccgaccucaaguccacgcagaacgccaucgacaagaucaccaacaaggugaacagcgucaucgagaagaugaacacccaguucaccgcggugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagucgacccggaucuaccagauccuggccaucuacuccaccgcggccagcucccugguccucguggugucgcugggcgccaucuccuucuggaugugcucgaacggcagccugcagugccgcaucugcaucuga

SEQ ID NO: 9256 - RNA, 1701 nt, Artificial Sequence; identical to SEQ ID NO: 8659
  derived and/or modified CDS sequence (AUadapt) from InfluenzaA__AFK74526__HA

SEQ ID NO: 9257 - RNA, 1701 nt, Artificial Sequence; identical to SEQ ID NO: 116
  derived and/or modified CDS sequence (AUadapt) from InfluenzaA__AFK74534__HA

SEQ ID NO: 9258 - RNA, 1701 nt, Artificial Sequence; identical to SEQ ID NO: 116
  derived and/or modified CDS sequence (AUadapt) from InfluenzaA__AFK74544__HA

SEQ ID NO: 9259 - RNA, 1701 nt, Artificial Sequence; identical to SEQ ID NO: 116
  derived and/or modified CDS sequence (AUadapt) from InfluenzaA__AFK74554__HA

SEQ ID NO: 9260 - RNA, 1701 nt, Artificial Sequence; identical to SEQ ID NO: 3156
  derived and/or modified CDS sequence (AUadapt) from InfluenzaA__AFK74564__HA

SEQ ID NO: 9261 - RNA, 1701 nt, Artificial Sequence; identical to SEQ ID NO: 5469
  derived and/or modified CDS sequence (AUadapt) from InfluenzaA__AFK74575__HA

SEQ ID NO: 9262 - RNA, 1701 nt, Artificial Sequence; identical to SEQ ID NO: 62
  derived and/or modified CDS sequence (AUadapt) from InfluenzaA__AFK74585__HA

SEQ ID NO: 9263 - RNA, 1701 nt, Artificial Sequence
  derived and/or modified CDS sequence (AUadapt) from InfluenzaA__AFK74595__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgaccugaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 9264 - RNA, 1701 nt, Artificial Sequence; identical to SEQ ID NO: 116
  derived and/or modified CDS sequence (AUadapt) from InfluenzaA__AFK74605__HA

SEQ ID NO: 9265 - RNA, 1701 nt, Artificial Sequence; identical to SEQ ID NO: 3156
  derived and/or modified CDS sequence (AUadapt) from InfluenzaA__AFK74615__HA

SEQ ID NO: 9266 - RNA, 1701 nt, Artificial Sequence; identical to SEQ ID NO: 3156
  derived and/or modified CDS sequence (AUadapt) from InfluenzaA__AFK74625__HA

SEQ ID NO: 9267 - RNA, 1701 nt, Artificial Sequence; identical to SEQ ID NO: 4016
  derived and/or modified CDS sequence (AUadapt) from InfluenzaA__AFK74635__HA

SEQ ID NO: 9268 - RNA, 1701 nt, Artificial Sequence; identical to SEQ ID NO: 4016
  derived and/or modified CDS sequence (AUadapt) from InfluenzaA__AFK74645__HA

SEQ ID NO: 9269 - RNA, 1701 nt, Artificial Sequence; identical to SEQ ID NO: 116
  derived and/or modified CDS sequence (AUadapt) from InfluenzaA__AFK74655__HA

SEQ ID NO: 9270 - RNA, 1701 nt, Artificial Sequence; identical to SEQ ID NO: 116
  derived and/or modified CDS sequence (AUadapt) from InfluenzaA__AFK74665__HA

SEQ ID NO: 9271 - RNA, 1701 nt, Artificial Sequence; identical to SEQ ID NO: 116
  derived and/or modified CDS sequence (AUadapt) from InfluenzaA__AFK74675__HA

SEQ ID NO: 9272 - RNA, 1701 nt, Artificial Sequence; identical to SEQ ID NO: 116
  derived and/or modified CDS sequence (AUadapt) from InfluenzaA__AFK74685__HA

SEQ ID NO: 9273 - RNA, 1701 nt, Artificial Sequence; identical to SEQ ID NO: 5469
  derived and/or modified CDS sequence (AUadapt) from InfluenzaA__AFK74695__HA

SEQ ID NO: 9274 - RNA, 1701 nt, Artificial Sequence; identical to SEQ ID NO: 116
  derived and/or modified CDS sequence (AUadapt) from InfluenzaA__AFK74705__HA

SEQ ID NO: 9275 - RNA, 1701 nt, Artificial Sequence; identical to SEQ ID NO: 116
  derived and/or modified CDS sequence (AUadapt) from InfluenzaA__AFK74715__HA

SEQ ID NO: 9276 - RNA, 1701 nt, Artificial Sequence; identical to SEQ ID NO: 116
  derived and/or modified CDS sequence (AUadapt) from InfluenzaA__AFK74725__HA

SEQ ID NO: 9277 - RNA, 1701 nt, Artificial Sequence; identical to SEQ ID NO: 116
  derived and/or modified CDS sequence (AUadapt) from InfluenzaA__AFK74735__HA

SEQ ID NO: 9278 - RNA, 1701 nt, Artificial Sequence; identical to SEQ ID NO: 116
  derived and/or modified CDS sequence (AUadapt) from InfluenzaA__AFK74745__HA

SEQ ID NO: 9279 - RNA, 1701 nt, Artificial Sequence; identical to SEQ ID NO: 116
  derived and/or modified CDS sequence (AUadapt) from InfluenzaA__AFK74755__HA

SEQ ID NO: 9280 - RNA, 1701 nt, Artificial Sequence; identical to SEQ ID NO: 5469
  derived and/or modified CDS sequence (AUadapt) from InfluenzaA__AFK74765__HA

SEQ ID NO: 9281 - RNA, 1701 nt, Artificial Sequence; identical to SEQ ID NO: 116
  derived and/or modified CDS sequence (AUadapt) from InfluenzaA__AFK74775__HA

SEQ ID NO: 9282 - RNA, 1701 nt, Artificial Sequence; identical to SEQ ID NO: 116
  derived and/or modified CDS sequence (AUadapt) from InfluenzaA__AFK74785__HA

SEQ ID NO: 9283 - RNA, 1701 nt, Artificial Sequence; identical to SEQ ID NO: 116
  derived and/or modified CDS sequence (AUadapt) from InfluenzaA__AFK74795__HA

SEQ ID NO: 9284 - RNA, 1701 nt, Artificial Sequence; identical to SEQ ID NO: 116
  derived and/or modified CDS sequence (AUadapt) from InfluenzaA__AFK74805__HA

SEQ ID NO: 9285 - RNA, 1701 nt, Artificial Sequence; identical to SEQ ID NO: 116
  derived and/or modified CDS sequence (AUadapt) from InfluenzaA__AFK74815__HA

SEQ ID NO: 9286 - RNA, 1701 nt, Artificial Sequence; identical to SEQ ID NO: 116
  derived and/or modified CDS sequence (AUadapt) from InfluenzaA__AFK74825__HA

SEQ ID NO: 9287 - RNA, 1701 nt, Artificial Sequence; identical to SEQ ID NO: 116
  derived and/or modified CDS sequence (AUadapt) from InfluenzaA__AFK74835__HA

SEQ ID NO: 9288 - RNA, 1701 nt, Artificial Sequence; identical to SEQ ID NO: 116
  derived and/or modified CDS sequence (AUadapt) from InfluenzaA__AFK74845__HA

SEQ ID NO: 9289 - RNA, 1701 nt, Artificial Sequence; identical to SEQ ID NO: 116
  derived and/or modified CDS sequence (AUadapt) from InfluenzaA__AFK74895__HA

SEQ ID NO: 9290 - RNA, 1701 nt, Artificial Sequence; identical to SEQ ID NO: 116
  derived and/or modified CDS sequence (AUadapt) from InfluenzaA__AFK74905__HA

SEQ ID NO: 9291 - RNA, 1701 nt, Artificial Sequence; identical to SEQ ID NO: 116
  derived and/or modified CDS sequence (AUadapt) from InfluenzaA__AFK74915__HA

SEQ ID NO: 9292 - RNA, 1701 nt, Artificial Sequence
  derived and/or modified CDS sequence (AUadapt) from InfluenzaA__AFK74925__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgugccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgcggccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucacgauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacggcaucaccaacaaggucaacuccgugaucgagaagaugaacacgcaguucaccgccgucggcaaggaguucaaccaccuggagaagcgcaucgagaaccugaacaagaagaucgacgacggguuccucgacaucuggaccuacaacgcggagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagucgacccgcaucuaccagauccuggccaucuacuccaccgucgccagcucgcuggugcucguggucucccugggcgcgaucagcuucuggaugugcuccaacggcagccugcagugccggaucugcaucuga

SEQ ID NO: 9293 - RNA, 1701 nt, Artificial Sequence; identical to SEQ ID NO: 4016
  derived and/or modified CDS sequence (AUadapt) from InfluenzaA__AFK74935__HA

SEQ ID NO: 9294 - RNA, 1701 nt, Artificial Sequence; identical to SEQ ID NO: 116
  derived and/or modified CDS sequence (AUadapt) from InfluenzaA__AFK74945__HA

SEQ ID NO: 9295 - RNA, 1701 nt, Artificial Sequence; identical to SEQ ID NO: 116
  derived and/or modified CDS sequence (AUadapt) from InfluenzaA__AFK74955__HA

SEQ ID NO: 9296 - RNA, 1701 nt, Artificial Sequence; identical to SEQ ID NO: 116
  derived and/or modified CDS sequence (AUadapt) from InfluenzaA__AFK74965__HA

SEQ ID NO: 9297 - RNA, 1701 nt, Artificial Sequence; identical to SEQ ID NO: 3005
  derived and/or modified CDS sequence (AUadapt) from InfluenzaA__AFK74975__HA

SEQ ID NO: 9298 - RNA, 1701 nt, Artificial Sequence; identical to SEQ ID NO: 116
  derived and/or modified CDS sequence (AUadapt) from InfluenzaA__AFK74985__HA

SEQ ID NO: 9299 - RNA, 1701 nt, Artificial Sequence; identical to SEQ ID NO: 5469
  derived and/or modified CDS sequence (AUadapt) from InfluenzaA__AFK74995__HA

SEQ ID NO: 9300 - RNA, 1701 nt, Artificial Sequence; identical to SEQ ID NO: 116
  derived and/or modified CDS sequence (AUadapt) from InfluenzaA__AFK75005__HA

SEQ ID NO: 9301 - RNA, 1701 nt, Artificial Sequence
  derived and/or modified CDS sequence (AUadapt) from InfluenzaA__AFK75015__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcguguga

SEQ ID NO: 9302 - RNA, 1701 nt, Artificial Sequence; identical to SEQ ID NO: 3156
  derived and/or modified CDS sequence (AUadapt) from InfluenzaA__AFK75025__HA

SEQ ID NO: 9303 - RNA, 1701 nt, Artificial Sequence; identical to SEQ ID NO: 3156
  derived and/or modified CDS sequence (AUadapt) from InfluenzaA__AFK75035__HA

SEQ ID NO: 9304 - RNA, 1701 nt, Artificial Sequence; identical to SEQ ID NO: 3156
  derived and/or modified CDS sequence (AUadapt) from InfluenzaA__AFK75045__HA

SEQ ID NO: 9305 - RNA, 1701 nt, Artificial Sequence; identical to SEQ ID NO: 3156
  derived and/or modified CDS sequence (AUadapt) from InfluenzaA__AFK75055__HA

SEQ ID NO: 9306 - RNA, 1701 nt, Artificial Sequence; identical to SEQ ID NO: 116
  derived and/or modified CDS sequence (AUadapt) from InfluenzaA__AFK75065__HA

SEQ ID NO: 9307 - RNA, 1701 nt, Artificial Sequence; identical to SEQ ID NO: 116
  derived and/or modified CDS sequence (AUadapt) from InfluenzaA__AFK75075__HA

SEQ ID NO: 9308 - RNA, 1701 nt, Artificial Sequence; identical to SEQ ID NO: 4078
  derived and/or modified CDS sequence (AUadapt) from InfluenzaA__AFK75085__HA

SEQ ID NO: 9309 - RNA, 1701 nt, Artificial Sequence; identical to SEQ ID NO: 4078
  derived and/or modified CDS sequence (AUadapt) from InfluenzaA__AFK75095__HA

SEQ ID NO: 9310 - RNA, 1701 nt, Artificial Sequence; identical to SEQ ID NO: 116
  derived and/or modified CDS sequence (AUadapt) from InfluenzaA__AFK75105__HA

SEQ ID NO: 9311 - RNA, 1701 nt, Artificial Sequence; identical to SEQ ID NO: 3156
  derived and/or modified CDS sequence (AUadapt) from InfluenzaA__AFK77857__HA

SEQ ID NO: 9312 - RNA, 1701 nt, Artificial Sequence; identical to SEQ ID NO: 3156
  derived and/or modified CDS sequence (AUadapt) from InfluenzaA__AFK77867__HA

SEQ ID NO: 9313 - RNA, 1701 nt, Artificial Sequence; identical to SEQ ID NO: 8442
  derived and/or modified CDS sequence (AUadapt) from InfluenzaA__AFK77877__HA

SEQ ID NO: 9314 - RNA, 1701 nt, Artificial Sequence; identical to SEQ ID NO: 116
  derived and/or modified CDS sequence (AUadapt) from InfluenzaA__AFK77887__HA

SEQ ID NO: 9315 - RNA, 1701 nt, Artificial Sequence
  derived and/or modified CDS sequence (AUadapt) from InfluenzaA__AFK77897__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacguccaaguacucgaagaaguucaagcccgagaucgccgugcggccgaagguccgcgaccaggagggccggaugaacuacuacuggacccugguggagcccggggacaagaucaccuucgaggcgaccggcaaccuccuggugccccgcuacgccuucgccauggagcggaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcggaucgagaaccucaacaagaagguggacgacggcuuccuggacaucuggaccuacaacgccgagcugcucguccugcuggagaacgagcgcacccucgacuaccacgacagcaacgugaagaaccuguacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgcgaggagaucgacggcgugaagcuggagagcacccggaucuaccagauccuggcgaucuacuccaccguggccucgagccucguccugguggugucccugggggccaucucguucuggaugugcuccaacggcagccuccagugccgcaucugcaucuga

SEQ ID NO: 9316 - RNA, 1701 nt, Artificial Sequence; identical to SEQ ID NO: 7295
  derived and/or modified CDS sequence (AUadapt) from InfluenzaA__AFK78028__HA

SEQ ID NO: 9317 - RNA, 1701 nt, Artificial Sequence; identical to SEQ ID NO: 3156
  derived and/or modified CDS sequence (AUadapt) from InfluenzaA__AFK78187__HA

SEQ ID NO: 9318 - RNA, 1701 nt, Artificial Sequence; identical to SEQ ID NO: 7100
  derived and/or modified CDS sequence (AUadapt) from InfluenzaA__AFM45476__HA

SEQ ID NO: 9319 - RNA, 1701 nt, Artificial Sequence
  derived and/or modified CDS sequence (AUadapt) from InfluenzaA__AFM45487__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 9320 - RNA, 1701 nt, Artificial Sequence; identical to SEQ ID NO: 7100
  derived and/or modified CDS sequence (AUadapt) from InfluenzaA__AFM45489__HA

SEQ ID NO: 9321 - RNA, 1701 nt, Artificial Sequence; identical to SEQ ID NO: 9319
  derived and/or modified CDS sequence (AUadapt) from InfluenzaA__AFM45494__HA

SEQ ID NO: 9322 - RNA, 1701 nt, Artificial Sequence
  derived and/or modified CDS sequence (AUadapt) from InfluenzaA__AFM68954__HA
augaaggcccgccugcucgugcugcugugcgcccucgcggccaccgacgccgacaccaucugcaucggcuaccacgccaacaacucgacggacaccgucgacacccugcuggagaagaacgugaccgugacgcacuccgucaaccuccuggaggacagccacaacgggaagcugugcaagcucaagggcaucgcgccccugcagcuggggaagugcaacaucgccggcuggcuccuggggaacccggagugcgacucccugcuccccgcccggagcugguccuacaucguggagacccccaacucggagaacggcgccugcuaccccggcgacuucaucgacuacgaggagcugaaggagcagcuguccagcguguccagccucgagcgcuucgagaucuucccgaaggaguccagcuggcccaaccacaacacccugaagggggucaccgccuccugcucgcacggcgggaaguccagcuucuaccggaaccugcucuggcugacgaagaccgaggacuccuaccccaagcugagcaacuccuacgugaacaacaagggcaaggaggugcucguccuguggggcgugcaccaccccagcucguccgacgagcagcagagccuguaccacaacgugaacgcguacgucuccguggugagcuccaacuacaacgggcgcuucaccccggagaucgccgcccggcccaagguccgcaaccagcccggccggaugaacuacuacuggacccuccuggagcccggggacacgaucaucuucgaggccaccggcaaccugaucgccccgugguacgcguucgcccucagccgcggguucggcuccggcaucaucaccucgaacgccuccaugcacgagugcaacaccaagugccagacgccccagggggccaucaacagcucccugcccuuccagaacauccaccccgugaccaucggcgagugcccgaaguacgugcggagcaccaagcugcgcauggucaccgggcuccggaacauccccuccauccaguuccgcggccuguucggggccaucgcgggcuucaucgagggcggguggacgggcaugaucgacgggugguacggcuaccaccaccagaacgagcaggggagcggcuacgccgccgaccagaaguccacccagaacgccaucaacggcaucaccaacaaggugaacucggugaucgagaagaugaacacccaguucacggccgucuccaaggaguucaacaaccuggagaagcggauggagaaccucaacaagaagguggacgacggguuccuggacaucuggaccuacaacgcggagcugcucgugcugcuggagaacgagcgcacccucgacuuccacgaccugaacgucaagaaccuguacgagaaggucaagagccagcucaagaacaacgccaaggagaucggcaacgggugcuucgaguucuaccacaagugcgacaacaagugcauggaguccgugcggaacggcaccuacgacuaccccaaguacagcgaggagagcaagcugaaccgcgagaagaucgacggggugaagcuggaguccaugggcguguaccagauccucgccaucuacucgacggucgccuccagccuggugcugcuggugucccucggcgccaucagcuucuggaugugcuccaacgggagccugcagugccggaucugcaucuga

SEQ ID NO: 9323 - RNA, 1701 nt, Artificial Sequence
  derived and/or modified CDS sequence (AUadapt) from InfluenzaA__AFM68965__HA
augaagaccaucaucgcccugucguacaucuucugccaggugcucgcccagaaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagaacgggggcagcuacgccugcaagcgcgggcccgacaacuccuucuucucgcggcugaacuggcucuacaaguccgagucgaccuaccccgugcugaacgucacgaugcccaacaacgacaacuucgacaagcuguacaucuggggcgugcaccacccguccaccgacaaggagcagaccaaccucuacgugcaggccagcggccgcgucaccguguccacgaagcggucgcagcagaccaucauccccaacguggggagccgccccuggguccggggccuguccucggggaucuccaucuacuggaccaucgugaagcccggcgacauccugcucaucaacagcaacggcaaccugaucgcgccgcgcggguacuucaagauccggaccggcaaguccucgaucaugcgcuccgacgcccccaucgggacgugcucguccgagugcaucacccccaacggcagcauccccaacgacaagccguuccagaacgugaacaagaucaccuacggggccugccccaaguacgucaagcagaacacccugaagcucgccacgggcaugcggaacgugcccgagaagcagacccgcggcaucuucggggccaaggcgggcuucaucgagaacgggugggagggcaugaucgacgggugguacggcuuccggcaccagaacuccgagggcaccgggcaggccgccgaccucaagucgacccaggccgccaucgaccagaucaacggcaagcugaaccgcgugaucgagaagacgaacgagaaguuccaccagaucgagaaggaguucuccgaggucgaggggcggauccaggaccucgagaaguacguggaggacaccaagaucgaccuguggagcuacaacgcggagcugcucguggcccuggagaaccagcacaccaucgaccugaccgacuccgagaugaacaagcuguucgagaagacgcgccggcagcugcgcgagaacgccgaggacaugggcaacgggugcuucaagaucuaccacaagugcgacaacgccugcaucggcucgauccggaacggcaccuacgaccacgacgucuaccgcgacgaggcccugaacaaccgcuuccagaucaaggggguggagcucaaguccggcuacaaggacuggauccuguggaucagcuucgcgaucuccugcuuccugcucugcgucgugcugcugggguucaucaugugggccugccagaagggcaacauccggugcaacaucugcaucuga

SEQ ID NO: 9324 - RNA, 1701 nt, Artificial Sequence
  derived and/or modified CDS sequence (AUadapt) from InfluenzaA__AFM68987__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagagcgggggcuccuacgccugcaagcgcgggucggacaaguccuucuucagccggcugaacuggcucuacgaguccgagagcaaguaccccgugcugaacgucaccaugcccaacaacggcaacuucgacaagcuguacaucuggggcgugcaccaccccuccacggacaaggagcagaccaaccucuacgugcgcgccucggggcgggucaccgugagcaccaagcgcucccagcagacggugaucccgaacaucggcucgcggcccuggguccgcgggcuguccagccggaucuccaucuacuggaccaucgugaagcccggcgacauccugcucaucaacagcaacggcaaccugaucgcgccccgcggguacuucaagauccggaccggcaaguccucgaucaugcgcuccgacgccccgaucgggaccugcagcuccgagugcaucacgcccaacggcucgauccccaacgacaagcccuuccagaacgugaacaagaucaccuacggggccugcccgaaguacgucaagcagaacacccugaagcucgccaccggcaugcggaacgugcccgagaagcagacgcgcggcaucuucggggccaucgcgggcuucaucgagaacgggugggagggcaugguggacgggugguacggcuuccggcaccagaacuccgagggcaccgggcaggccgccgaccucaagagcacccaggccgccaucgaccagaucaacggcaagcugaaccgcgucaucgagaagaccaacgagaaguuccaccagaucgagaaggaguucuccgagguggaggggcggauccaggaccucgagaaguacguggaggacacgaagaucgaccuguggagcuacaacgcggagcugcucgucgcccuggagaaccagcacaccaucgaccugaccgacuccgagaugaacaagcuguucgagaagacccgccggcagcugcgcgagaacgccgaggacaugggcaacgggugcuucaagaucuaccacaagugcgacaacgccugcaucggcucgauccgcaacggcacguacgaccacgacguguaccgggacgaggcccugaacaaccgcuuccagaucaagggggucgagcucaaguccggcuacaaggacuggauccuguggaucagcuucgcgaucagcugcuuccugcucugcguggugcugcugggguucaucaugugggccugccagaagggcaacauccggugcaacaucugcaucuga

SEQ ID NO: 9325 - RNA, 1701 nt, Artificial Sequence
  derived and/or modified CDS sequence (AUadapt) from InfluenzaA__AFM71720__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcuccaaggccuacuccaacugcuaccccuacgacgugccggacuacgcgagccugcggucccucgucgccucguccggcacgcuggaguucaucaacgaggacuucaacuggaccggggugacccagagcggcggguccuacgccugcaagcgcggcucggugaacuccuucuucagccggcugaacuggcuccacgaguccgaguacaaguaccccgcccugaacgucgcgaugcccaacaacgggaaguucgacaagcuguacaucuggggcgugcaccaccccaucaccgaccgcgagcagacgaaccucuacgugcgggccagcggccgcgucaccguguccaccaagcggucgcagcagaccgugaucccgaacaucgggagccgccccuggguccggggccuguccagccgcaucuccaucuacuggacgaucgugaagcccggggacauccuguucaucaacucgaccggcaaccucaucgcgccccggggcuacuucaagauccgcaccgggaaguccagcaucaugcgguccgacgccccgaucgggaccugcucguccgagugcaucacgcccaacggcagcauccccaacgacaagcccuuccagaacgugaacaagaucaccuacggcgccugcccgcgcuacgucaagcagaacacccugaagcuggccaccgggaugcggaacgugcccgagaagcagacgcgcggcaucuucggcgccaucgccggguucaucgagaacggcugggaggggaugguggacggcugguacggguuccggcaccagaacuccgagggcaccggccaggccgccgaccucaagagcacccaggcggccaucgaccagaucaacgggaagcugaaccgccugaucgagaagaccaacgagaaguuccaccagaucgagaaggaguucuccgaggucgagggccggauccaggaccucgagaaguacguggaggacacgaagaucgaccuguggucguacaacgccgagcugcucguggcccuggagaaccagcacaccaucgaccugaccgacuccgagaugaacaagcuguucgagaagacccgcaagcagcuccgcgagaacgccgaggacauggggaacggcugcuucaagaucuaccacaagugcgacaacgcgugcaucgggagcauccggaacggcacguacgaccacgacgucuaccgcgacgaggcccugaacaaccgguuccagaucaagggcguggagcucaaguccggguacaaggacuggauccuguggaucagcuucgccaucuccugcuuccugcucugcgucgugcugcugggcuucaucaugugggccugccagaaggggaacauccgcugcaacaucugcaucuga

SEQ ID NO: 9326 - RNA, 1701 nt, Artificial Sequence
  derived and/or modified CDS sequence (AUadapt) from InfluenzaA__AFM71731__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagagcggcgaguccuacgccugcaagcgcgggucggugaaguccuucuucagccggcucaacuggcugcacaaguccgaguacaaguaccccgcgcugaacgucaccaugcccaacaacggcaaguucgacaagcucuacaucuggggcgugcaccaccccucgaccgaccgcgagcagacgaaccuguacgugcgggccuccgggcgcgucaccgugagcaccaagcggucgcagcagaccgugaucccgaacaucggcucccgccccuggguccgggggcugagcucccgcaucucgaucuacuggacgaucgugaagcccggcgacauccuccugaucaacuccaccgggaaccugaucgcgccccggggcuacuucaagauccgcaccggcaagagcuccaucaugcggucggacgccccgaucgggaccugcuccagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacucggaggggaccggccaggccgccgaccugaaguccacccaggcggccaucgaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacucggagaugaacaagcuguucgagaagacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggcuacaaggacuggauccucuggaucuccuucgccaucagcugcuuccugcugugcgucgugcuccugggguucaucaugugggccugccagaagggcaacauccggugcaacaucugcaucuga

SEQ ID NO: 9327 - RNA, 1701 nt, Artificial Sequence
  derived and/or modified CDS sequence (AUadapt) from InfluenzaA__AFM71754__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccucggggcggaucaccguguccacgaagcgcucgcagcagaccgccauccccaacaucggcagccggccccgcgugcggaacauccccucccgcaucucgaucuacuggaccaucgucaagccgggcgacauccugcugaucaacuccaccgggaaccucaucgcgccccggggcuacuucaagauccgcucggggaaguccagcaucaugcgguccgacgcccccaucggcaagugcaacucggagugcaucacgcccaacggcuccaucccgaacgacaagcccuuccagaacgugaaccgcaucaccuacggggccugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgcccacgacguguaccgggacgaggcccugaacaaccgcuuccagaucaagggggucgagcucaagucgggcuacaaggacuggauccuguggaucuccuucgccaucagcugcuuccugcucugcguggcgcugcugggcuucaucaugugggccugccagaaggggaacauccggugcaacaucugcaucuga

SEQ ID NO: 9328 - RNA, 1701 nt, Artificial Sequence
  derived and/or modified CDS sequence (AUadapt) from InfluenzaA__AFM71768__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacgacuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggcgugacccagaacgggaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccucgggccggaucaccguguccacgaagcgcucgcagcagaccgccauccccaacaucgggagccggccccgcgugcggaacauccccucccgcaucucgaucuacuggaccaucgucaagccgggcgacauccugcugaucaacuccaccggcaaccucaucgcgccccggggguacuucaagauccgcucgggcaaguccagcaucaugcgguccgacgcccccaucgggaagugcaacucggagugcaucacgcccaacggcuccaucccgaacgacaagcccuuccagaacgugaaccgcaucaccuacggcgccugcccccgguacgugaagcagaacacccugaagcuggccaccgggaugcgcaacguccccgagaagcagacgcggggcaucuucggggccaucgccggcuucaucgagaacgggugggagggcaugguggacggcugguacggguuccgccaccagaacucggagggccgggggcaggccgcggaccucaaguccacccaggccgccaucgaccagaucaacggcaagcugaaccgccugaucgggaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggaccuacgcccacgacguguaccgggacgaggcccugaacaaccgcuuccagaucaagggcgucgagcucaagucgggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 9329 - RNA, 1701 nt, Artificial Sequence
  derived and/or modified CDS sequence (AUadapt) from InfluenzaA__AFM71791__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcaccggggagaucugcgacucgccccaccagauccucgacggcaagaacugcacgcugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacccuggaguucaacaacgagucguucaacuggaccggggugacccagaacggcacguccucggccugcauccgccgguccaagaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuucccguacgcgcaggccucggggcggaucacgguguccaccaagcgcucgcagcagaccgugauccccaacaucggcagccggccccgcguccggaacauccccucccgcaucucgaucuacuggaccaucgugaagccgggcgacauccugcugaucaacuccacggggaaccucaucgcgccccggggcuacuucaagauccgcucggggaaguccagcaucaugcgguccgacgcccccaucggcaagugcaacucggagugcaucacccccaacggcuccaucccgaacgacaagcccuuccagaacgugaaccgcaucaccuacggggccugcccccgguacgucaagcagaacacccugaagcuggccacgggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccucaaguccacccaggcggccaucgaccagaucaacgggaagcugaaccgccugaucggcaagaccaacgagaaguuccaccagaucgagaaggaguucagcgaggucgagggccggauccaggaccucgagaaguacguggaggacacgaagaucgaccugugguccuacaacgccgagcugcucguggcccuggagaaccagcacaccaucgagcugaccgacucggagaugaacaagcuguucgagaagaccaagaagcagcuccgcgagaacgccgaggacauggggaacggcugcuucaagaucuaccacaagugcgacaacgcgugcaucggguccauccgcaacggcacguacgaccacgacgucuaccgggacgaggcccugaacaaccgcuuccagaucaaggggguggagcucaagucgggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 9330 - RNA, 1701 nt, Artificial Sequence
  derived and/or modified CDS sequence (AUadapt) from InfluenzaA__AFM71824__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggggugacccaggacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccucggggcggaucaccguguccacgaagcgcucgcagcagaccgccauccccaacaucggcagccggccccgcgugcggaacauccccucccgcaucucgaucuacuggaccaucgucaagccgggcgacauccugcugaucaacuccaccgggaaccucaucgcgccccggggcuacuucaagauccgcucggggaaguccagcaucaugcgguccgacgcccccaucggcaagugcaacucggagugcaucacgcccaacggcuccaucccgaacgacaagcccuuccagaacgugaaccgcaucaccuacggggccugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagucgggcuacaaggacuggauccuguggaucuccuucgccaucagcugcuuccugcucugcguggcccugcugggcuucaucaugugggcgugccagaaggggaacauccggugcaacaucugcaucuga

SEQ ID NO: 9331 - RNA, 1701 nt, Artificial Sequence
  derived and/or modified CDS sequence (AUadapt) from InfluenzaA__AFM71835__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccagcugcuaccccuacgacgugccggacuacgcgucccugcggucgcucgucgccuccagcggcacgcuggaguucaacuccgagucguucaacuggaccggggugacccagaacggcaccuccagcgccugcauccgccgguccuacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccagcgggcggaucaccgugucgacgaagcgcucccagcaggccgugauccccaacaucggcagccggccccgcguccggaacauccccucccgcaucucgaucuacuggaccaucgugaagccgggcgacauccugcugaucaacuccaccgggaaccucaucgcgccccggggcuacuucaagauccgcagcgggaaguccucgaucaugcgguccgacgcccccaucggcaagugcaacagcgagugcaucacccccaacggcuccaucccgaacgacaagcccuuccagaacgugaaccgcaucacguacggggccugcccccgguacaucaagcagucgacccugaagcuggccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaagggggucgagcucaaguccggcuacaaggacuggauccuguggaucucgcuggccaucagcugcuuccuccugugcguggcccugcucggcuucaucaugugggcgugccagaaggggaacauccggugcaacaucugcaucuga

SEQ ID NO: 9332 - RNA, 1698 nt, Artificial Sequence
  derived and/or modified CDS sequence (AUadapt) from InfluenzaA__AFM71846__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcugaagaacucguacgucaacaagaagggcaaggaggugcucgugcugugggggauccaccacccguccaacagcaaggagcagcagaaccuguaccagaacgagaacgcguacgucuccguggugacgucgaacuacaaccggcgcuucacccccgagaucgccgagcggcccaagguccgcgaccaggccggccggaugaacuacuacuggacccuccugaagcccggcgacaccaucaucuucgaggccaacgggaaccugaucgccccgauguacgcguucgcccucagccgcggcuucggguccggcaucaucacgagcaacgccuccaugcacgagugcaacaccaagugccagacgccccugggcgccaucaacucgucccugcccuaccagaacauccaccccgugaccaucggggagugcccgaaguacgugcggagcgccaagcuccgcauggucaccggccugcggaacauccccuccauccagucgcgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagucgcagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagucgaugggcaucuaccagauccucgccaucuacuccaccgucgccagcucccuggugcugcucgugucgcugggcgcgaucagcuucuggaugugcuccaacgggagccugcagugccggaucugcaucuga

SEQ ID NO: 9333 - RNA, 1701 nt, Artificial Sequence; identical to SEQ ID NO: 65
  derived and/or modified CDS sequence (AUadapt) from InfluenzaA__AFM71857__HA

SEQ ID NO: 9334 - RNA, 1701 nt, Artificial Sequence
  derived and/or modified CDS sequence (AUadapt) from InfluenzaA__AFM71868__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcuccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgugaccgacaacgaccagauccggcuguacgcccaggcguccgggcgcaucaccgugucgacgaagcggagccagcagaccgucaucccgaacaucggcucccgcccccgggugcgcgacauccccucgcggaucuccaucuacuggaccaucgugaagcccggcgacauccugcucaucaacagcaccgggaaccugaucgccccgcgcggcuacuucaagauccgguccgggaaguccuccaucaugcgcucggacgcccccaucggcaagugcaacuccgagugcaucacgcccaacggcagcauccccaacgacaagccguuccagaacgucaaccggaucaccuacggggccugcccccgcuacgugaagcagaacacccugaagcucgccaccggcaugcggaacgugcccgagaagcagacgcgcgggaucuucggcgcgaucgccggguucaucgagaacggcugggagggcauggucgacgggugguacggcuuccggcaccagaacuccgaggggaucggccaggccgccgaccucaagucgacccaggccgcgaucaaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcaccaagaagcagcugcgcgagaacgccgaggacauggggaacggcugcuucaagaucuaccacaagugcgacaacgccugcaucgggucgauccggaacggcaccuacgaccacgacguguaccgcgacgaggcgcucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 9335 - RNA, 1701 nt, Artificial Sequence; identical to SEQ ID NO: 7243
  derived and/or modified CDS sequence (AUadapt) from InfluenzaA__AFM71879__HA

SEQ ID NO: 9336 - RNA, 1701 nt, Artificial Sequence
  derived and/or modified CDS sequence (AUadapt) from InfluenzaA__AFM71890__HA
augaaggcccgccugcucgugcugcugugcgcccucgcggccaccgacgccgacaccaucugcaucggcuaccacgccaacaacucgacggacaccgucgacacccugcuggagaagaacgugaccgugacgcacuccgucaaccuccuggaggacagccacaacgggaagcugugcaagcucaagggcaucgcgccccugcagcuggggaagugcaacaucgccggcuggcuccuggggaacccggagugcgacucccugcuccccgcccggagcugguccuacaucguggagacccccaacucggagaacggcgccugcuaccccggcgacuucaucgacuacgaggagcugaaggagcagcuguccagcguguccagccucgagcgcuucgagaucuucccgaaggaguccagcuggcccaaccacaacacccugaagggggucaccgccuccugcucgcacggcgggaaguccagcuucuaccggaaccugcucuggcugacgaagaccgaggacuccuaccccaagcugagcaacuccuacgugaacaacaagggcaaggaggugcucguccuguggggcgugcaccaccccagcucguccgacgagcagcagagccuguaccacaacgugaacgcguacgucuccguggugagcuccaacuacaaccgccgguucaccccggagaucgccgcccgccccaagguccggaaccagcccgggcgcaugaacuacuacuggacccuccuggagcccggcgacacgaucaucuucgaggccaccgggaaccugaucgccccgugguacgcguucgcccucagccggggcuucggguccggcaucaucaccucgaacgccuccaugcacgagugcaacaccaagugccagacgccccagggcgccaucaacagcucccugcccuuccagaacauccaccccgugaccaucggggagugcccgaaguacgugcgcagcaccaagcugcggauggucaccggccuccgcaacauccccuccauccaguuccgggggcuguucggcgccaucgcgggguucaucgagggcggcuggacggggaugaucgacggcugguacggguaccaccaccagaacgagcagggcagcggguacgccgccgaccagaaguccacccagaacgccaucaacggcaucaccaacaaggugaacucggugaucgagaagaugaacacccaguucacggccgucuccaaggaguucaacaaccuggagaagcgcauggagaaccucaacaagaagguggacgacggcuuccuggacaucuggaccuacaacgcggagcugcucgugcugcuggagaacgagcggacccucgacuuccacgaccugaacgucaagaaccuguacgagaaggucaagagccagcucaagaacaacgccaaggagaucgggaacggcugcuucgaguucuaccacaagugcgacaacaagugcauggaguccgugcgcaacgggaccuacgacuaccccaaguacagcgaggagagcaagcugaaccgggagaagaucgacggcgugaagcuggaguccauggggguguaccagauccucgccaucuacucgacggucgccuccagccuggugcugcuggugucccucggcgccaucagcuucuggaugugcuccaacggcagccugcagugccgcaucugcaucuga

SEQ ID NO: 9337 - RNA, 1701 nt, Artificial Sequence; identical to SEQ ID NO: 9322
  derived and/or modified CDS sequence (AUadapt) from InfluenzaA__AFM71901__HA

SEQ ID NO: 9338 - RNA, 1701 nt, Artificial Sequence
  derived and/or modified CDS sequence (AUadapt) from InfluenzaA__AFM71923__HA
augaagaccaucaucgcccugucguacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccucgaccggcaagaucugcaacaacccccaccgcauccuggacgggaucgacugcacccugaucgacgcccuccugggcgacccccacugcgacuccuuccagaacgagacgugggaccuguucguggagcggagcaaggccuucuccaacugcuaccccuacgacgugccggacuacgccucgcuccgcucccuggucgcgagcuccggcacccuggaguucaucaacgagggguucaccuggaccggcgugacgcagaacgggggcagcaacgccugcaagcgggggcccgacuccggcuucuucucgcgccucaacuggcuguacaaguccggcagcaccuaccccgugcugaacgucaccaugcccaacaacgacaacuucgacaagcucuacaucuggggcgugcaccacccguccaccaaccaggagcagacgucgcuguacgugcaggccuccggccgggucaccgugagcaccaagcgcucgcagcagaccaucauccccaacaucgggucccggcccugggugcgcggccugagcucccggaucagcaucuacuggacgaucgucaagcccggcgacauccucgugaucaacuccaacgggaaccugaucgccccgcgcggcuacuucaagaugcggaccggcaagucguccaucaugcgcagcgacgcgcccaucgggaccugcaucuccgagugcaucacccccaacgggucgauccccaacgacaagccguuccagaacgugaacaagaucacguacggggccugccccaaguacgucaagcagaacacccugaagcucgccaccggcaugcggaacgugcccgagaagcagacccgcgggcuguucggcgccaucgccggguucaucgagaacggcugggaggggaugaucgacggcugguacggcuuccggcaccagaacuccgaggggacgggccaggcggccgaccucaagagcacccaggccgccaucgaccagaucaacgggaagcugaaccgcgugaucgagaagaccaacgagaaguuccaccagaucgagaaggaguucuccgaggucgagggccggauccaggaccuggagaaguacguggaggacaccaagaucgaccuguggucguacaacgccgagcuccugguggcgcuggagaaccagcacacgaucgaccucaccgacuccgagaugaacaagcuguucgagaagacccgccggcagcugcgcgagaacgccgaggacauggggaacggcugcuuccggaucuaccacaagugcgacaacgccugcaucggcagcauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggcgugccagaagggcaacauccgcugcaacaucugcaucuga

SEQ ID NO: 9339 - RNA, 1701 nt, Artificial Sequence
  derived and/or modified CDS sequence (AUadapt) from InfluenzaA__AFM71934__HA
augaagaccaucaucgcccugucguacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccucgaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcucgcuggucgcguccagcgggacccuggaguucaucaacgagggcuucaccuggaccggggugacgcagaacggcggguccaacgccugcaagcggggccccgacucgggcuucuucucccgccucaacuggcuguacaagagcggguccaccuaccccgugcugaacgucaccaugcccaacaacgacaacuucgacaagcucuacaucuggggcgugcaccacccgucgaccaaccaggagcagacgucccuguacgugcaggccagcgggcgggucaccguguccaccaagggcucgcagcagaccaucauccccaacaucggcagccgccccugggugcgggggcuguccucgcgcaucuccaucuacuggacgaucgucaagcccggcgacauccucgugaucaacagcaacgggaaccugaucgccccgcggggcuacuucaagaugcgcaccgggaaguccucgaucaugcgguccgacgcgcccaucgggaccugcaucagcgagugcaucacccccaacggcuccauccccaacgacaagccguuccagaacgugaacaagaucacguacggcgccugccccaaguacgucaagcagaacacccugaagcucgccaccggcaugcgcaacgugcccgagaagcagacccgggggcuguucggcgccaucgccggguucaucgagaacggcugggagggcaugaucgacgggugguacggcuuccgccaccagaacucggaggggacgggccaggcggccgaccugaaguccacccaggccgccaucgaccagaucaacgggaagcucaaccgggugaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacacgaucgaccucaccgacucggagaugaacaagcuguucgagaagacccggcgccagcugcgggagaacgccgaggacaugggcaacgggugcuuccgcaucuaccacaagugcgacaacgccugcaucggcuccauccggaacgggaccuacgaccacgacgucuaccgcgacgaggcccucaacaaccgcuuccagaucaagggcguggagcucaagagcggcuacaaggacuggauccuguggaucuccuucgccaucagcugcuuccugcugugcgucgugcugcucggguucaucaugugggcgugccagaagggcaacauccggugcaacaucugcaucuga

SEQ ID NO: 9340 - RNA, 1701 nt, Artificial Sequence
  derived and/or modified CDS sequence (AUadapt) from InfluenzaA__AFM71945__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucaacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaacgagggcuucaccuggaccggggugacgcagaacggcggguccaacgccugcaagcggggccccgacucgggcuucuucucccgccugaacuggcucuacaagagcggguccgccuaccccgugcugaacgucaccaugcccaacaacgacaacuucgacaagcuguacaucuggggcgugcaccacccgucgaccgaccaggagcagaccaaccucuacgugcaggccuccgggcgggucacggugagcaccaagcgcucccagcagaccaucauccccaacaucggcagccggcccugggugcgcggccugucgucccggaucagcaucuacuggaccaucgucaagcccggggacauccuggugaucaacuccaacggcaaccucaucgcgccgcgcggguacuucaagaugcggacgggcaagucguccaucaugcgcagcgacgcccccaucgggaccugcaucuccgagugcaucacccccaacggcucgauccccaacgacaagccguuccagaacgugaacaagaucaccuacggcgccugccccaaguacgucaagcagaacacgcugaagcuggccaccgggaugcggaacgugcccgagaagcagacccgcggcaucuucggggccaucgcgggcuucaucgagaacgggugggagggcaugaucgacggcugguacggguuccggcaccagaacuccgagggcaccgggcaggccgccgaccucaagagcacgcaggccgccaucgaccagaucaacggcaagcugaaccgcgugaucgagaagaccaacgagaaguuccaccagaucgagaaggaguucuccgaggucgaggggcggauccaggaccuggagaaguacguggaggacaccaagaucgaccucuggucguacaacgcggagcugcugguggcccucgagaaccagcacaccaucgaccugacggacuccgagaugaacaagcuguucgagaagacccgccggcagcuccgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcugaaguccggcuacaaggacuggauccucuggaucagcuucgcgaucuccugcuuccugcugugcgucgugcuccugggcuucaucaugugggccugccagaaggggaacauccggugcaacaucugcaucuga

SEQ ID NO: 9341 - RNA, 1701 nt, Artificial Sequence; identical to SEQ ID NO: 9340
  derived and/or modified CDS sequence (AUadapt) from InfluenzaA__AFM71956__HA

SEQ ID NO: 9342 - RNA, 1704 nt, Artificial Sequence
  derived and/or modified CDS sequence (AUadapt) from InfluenzaA__AFM71978__HA
augaagaccaucaucgcccugucguacaucuucugccucguguucgcccaggaccugcccggcaacgacaacaacuccaccgcgacgcugugccucgggcaccacgccgucccgaacggcacccuggugaagaccaucaccaacgaccagaucgaggugacgaacgccaccgagcugguccagucguccagcaccgggaagaucugcaacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccaacgccugcaagcgggggcccgacagcggcuucuucucccgccugaacuggcucuacaagucgggcuccaccuaccccgugcagaacgucacgaugcccaacaacgacaacucggacaagcuguacaucuggggcgugcaccacccguccaccgacaaggagcagaccaaccuguacgugcaggccagcgggaaggucaccguguccacgaagcggucgcagcagaccaucauccccaacguggggagccgccccuggguccggggccucuccucgcgcaucuccaucuacuggaccaucgugaagcccggcgacauccuggugaucaacagcaacgggaaccugaucgcgccgcggggcuacuucaagaugcgcaccgggaaguccucgaucaugcgguccgacgcccccaucggcacgugcucguccgagugcaucacccccaacgggagcauccccaacgacaagccguuccagaacgucaacaagaucaccuacggcgccugccccaaguacgugaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcucgauccgcaacgggaccuacgaccacgacguguaccgggacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagaagggcaacauccgcugcaacaucugcaucuga

SEQ ID NO: 9343 - RNA, 1701 nt, Artificial Sequence
  derived and/or modified CDS sequence (AUadapt) from InfluenzaA__AFM71989__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccagcaccgacaaggaccagaucuuccuguacacccaggcggccgggcggaucacgguguccaccaagcgcucgcagcaggccgugaucccgaacaucgggucgcggccccgcguccggaacauccccucccgcgugagcaucuacuggaccaucgugaagcccggcgacauccugcucaucaacuccaccggcaaccugaucgccccgcggggguacuucaagauccgcucgggcaaguccagcaucaugcgguccgacgcccccaucgggaagugcaacucggcgugcaucacgcccaacggcuccauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacucggagggccgggggcaggcggccgaccugaaguccacccaggccgccaucgaccagaucaacggcaagcugaaccgccucaucgggaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggguacaaggacuggauccuguggaucuccuucgccaucagcugcuuccuccugugcgucgcgcugcucggcuucaucaugugggccugccagaagggcaacauccggugcaacaucugcaucuga

SEQ ID NO: 9344 - RNA, 1701 nt, Artificial Sequence
  derived and/or modified CDS sequence (AUadapt) from InfluenzaA__AFM72010__HA
augaagaccaucaucgcccugucguacaucuucugccaggugcucgcccagaaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagaacgggggcagcuacgccugcaagcgcgggcccgacaaguccuucuucucgcggcugaacuggcucuacgaguccgagagcaccuaccccgugcugaacgucacgaugcccaacaacgacaacuucgacaagcuguacaucuggggcgugcaccacccguccaccgacaaggagcagaccaagcucuacgugcaggccucgggccgcgucaccguguccacgaagcggagccagcagaccaucauccccaacguggggucgcgccccuggguccggggccuguccagccgcaucuccaucuacuggaccaucgugaagcccggggacauccugcucaucaacucgaacggcaaccugaucgcgccgcggggcuacuucaagauccgcaccgggaaguccagcaucaugcgguccgacgcccccaucggcacgugcucguccgagugcaucacccccaacgggagcauccccaacgacaagccguuccagaacgugaacaagaucaccuacggcgccugccccaaguacgucaagcagaacacccugaagcucgccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagucgacccaggccgccaucgaccagaucaacgggaagcugaaccgggugaucgagaagacgaacgagaaguuccaccagaucgagaaggaguucuccgaggucgagggccgcauccaggaccucgagaaguacguggaggacaccaagaucgaccuguggagcuacaacgcggagcugcucguggcccuggagaaccagcacaccaucgaccugaccgacuccgagaugaacaagcuguucgagaagacgcggcgccagcugcgggagaacgccgaggacauggggaacggcugcuucaagaucuaccacaagugcgacaacgccugcaucgggucgauccgcaacggcaccuacgaccacgacgucuaccgcgacgaggcccugaacaaccgguuccagaucaagggcguggagcucaaguccggguacaaggacuggauccuguggaucagcuucgcgaucuccugcuuccugcucugcgucgugcugcugggcuucaucaugugggccugccagaaggggaacauccgcugcaacaucugcaucuga

SEQ ID NO: 9345 - RNA, 1701 nt, Artificial Sequence; identical to SEQ ID NO: 1160
  derived and/or modified CDS sequence (AUadapt) from InfluenzaA__AFM72021__HA

SEQ ID NO: 9346 - RNA, 1701 nt, Artificial Sequence
  derived and/or modified CDS sequence (AUadapt) from InfluenzaA__AFM72032__HA
augaagaccaucaucgcccugucguacauguucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagagcgggggcuccuacacgugcaagcgcgggucgaacaacuccuucuucagccggcugaacuggcucuacgaguccgagagcaaguaccccgugcugaacgucaccaugcccaacaacggcaaguucgacaagcuguacaucuggggcauccaccaccccuccaccgacaaggagcagaccaaccucuacauccgcgccucggggcgggugaccgugagcacgaagcgcucccagcagaccgucaucccgaacaucggcucgcggcccugggugcgcgggcuguccagccggaucuccaucuacuggaccaucgugaagcccggcgacauccugcucaucaacagcaccggcaaccugaucgcgccccgcggguacuucaagauccggacgggcaaguccucgaucaugcgcuccgacgccccgaucgggaccugcagcuccgagugcaucacccccaacggcucgauccccaacgacaagcccuuccagaacgucaacaagaucaccuacggggccugcccgcgguacgugaagcagaacacgcugaagcucgccaccggcaugcgcaacgugcccgagaagcagacccggggcaucuucggggccaucgccggcuucaucgagaacgggugggagggcauggucgacgggugguacggcuuccgccaccagaacuccgagggcaccgggcaggcggccgaccucaagagcacgcaggccgccaucgaccagaucaacggcaagcugaaccgggugaucgagaagaccaacgagaaguuccaccagaucgagaaggaguucuccgagguggaggggcgcauccaggaccucgagaaguacgucgaggacaccaagaucgaccuguggagcuacaacgccgagcugcucguggcgcuggagaaccagcacaccaucgaccugacggacuccgagaugaacaagcuguucgagaagacccggaagcagcugcgcgagaacgccgaggacaugggcaacgggugcuucaagaucuaccacaagugcgacaacgccugcaucggcucgauccgcaacggcaccuacgaccacgacguguaccgggacgaggcccugaacaaccgcuuccagaucaagggggucgagcucaaguccggcuacaaggacuggauccuguggaucagcuucgccaucagcugcuuccugcucugcgugguccugcugggguucaucaugugggcgugccagaagggcaacauccggugcaacaucugcaucuga

SEQ ID NO: 9347 - RNA, 1701 nt, Artificial Sequence
  derived and/or modified CDS sequence (AUadapt) from InfluenzaA__AFM72043__HA
augaagaccaucaucgcccugucguacauguucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagagcgggggcuccucgacgugcaagcgcggguccaacaacagcuucuucucccggcugaacuggcucuacgagagcgaguccaaguaccccgugcugaacgucaccaugcccaacaacggcaaguucgacaagcuguacaucuggggcauccaccaccccucgaccgacaaggagcagaccaaccucuacauccgcgccagcgggcgggugaccguguccacgaagcgcucgcagcagaccgucaucccgaacaucggcucccggcccugggugcgcgggcugagcucccggaucagcaucuacuggaccaucgugaagcccggcgacauccugcucaucaacuccaccggcaaccugaucgcgccccgcggguacuucaagauccggacgggcaagucguccaucaugcgcagcgacgccccgaucgggaccugcuccucggagugcaucacccccaacggcuccauccccaacgacaagcccuuccagaacgucaacaagaucaccuacggggccugcccgcgguacgugaagcagaacacgcugaagcucgccaccggcaugcgcaacgugcccgagaagcagacccggggcaucuucggggccaucgccggcuucaucgagaacgggugggagggcauggucgacgggugguacggcuuccgccaccagaacagcgagggcaccgggcaggcggccgaccugaaguccacgcaggccgccaucgaccagaucaacggcaagcugaaccgggugaucgagaagaccaacgagaaguuccaccagaucgagaaggaguucagcgagguggaggggcgcauccaggaccucgagaaguacgucgaggacaccaagaucgaccugugguccuacaacgccgagcugcucguggcgcuggagaaccagcacaccaucgaccugacggacucggagaugaacaagcuguucgagaagacccggaagcagcuccgcgagaacgccgaggacaugggcaacgggugcuucaagaucuaccacaagugcgacaacgccugcaucggcuccauccgcaacggcaccuacgaccacgacguguaccgggacgaggcccugaacaaccgcuuccagaucaagggggucgagcucaagagcggcuacaaggacuggauccuguggaucagcuucgccaucuccugcuuccugcucugcgugguccugcugggguucaucaugugggcgugccagaagggcaacauccggugcaacaucugcaucuga

SEQ ID NO: 9348 - RNA, 1701 nt, Artificial Sequence
  derived and/or modified CDS sequence (AUadapt) from InfluenzaA__AFM72054__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagucgcucuucuccaagaaguccuggagcuacaucgccgagacccccaacagcgagaacgggaccugcuaccccggcuacuucgccgacuacgaggagcugcgcgagcagcuguccucgguguccagcuucgagcgguucgagaucuuccccaaggaguccagcuggccgaagcacaacgucaccaagggggugacggccgccugcucccacaagggcaagucguccuucuaccgcaaccuccuguggcugaccgagaagaacgggagcuaccccaaccucuccaagagcuacgugaacaacaaggagaaggagguccuggugcuguggggcgugcaccaccccucgaacaucgaggaccagaagaccaucuaccggaaggagaacgcguacgucuccguggugagcucccacuacaaccgccgguucacccccgagaucgccaagcgcccgaagguccggaaccaggaggggcgcaucaacuacuacuggacgcuccuggagcccggcgacaccaucaucuucgaggccaacggcaaccugaucgcccccugguacgccuucgcgcucagccggggguucggcuccgggaucaucaccucgaacgccuccauggacgagugcgacgccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagucgcggggccuguucggggccaucgcgggcuucaucgagggcggcuggaccggcaugaucgacgggugguacggcuaccaccaccagaacgagcagggguccggcuacgccgccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgcggagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagucggucaagaacgggaccuacgacuacccgaaguacuccgaggagagcaagcucaaccgcgagaagaucgacggcgugaagcuggagagcauggggguguaccagauccuggccaucuacuccaccgucgccucgucccucgugcugcuggugagccucggcgccaucuccuucuggaugugcagcaacggcucccugcagugccggaucugcaucuga

SEQ ID NO: 9349 - RNA, 1701 nt, Artificial Sequence; identical to SEQ ID NO: 9348
  derived and/or modified CDS sequence (AUadapt) from InfluenzaA__AFM72065__HA

SEQ ID NO: 9350 - RNA, 1701 nt, Artificial Sequence
  derived and/or modified CDS sequence (AUadapt) from InfluenzaA__AFM72087__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacucgccccaccggauccucgacggcaagaacugcacccugaucgacgcccugcucggggacccccacugcgacggcuuccagaacgagaagugggaccuguucaucgagcgcagcaaggccuucuccaacugcuaccccuacgacgugccggacuacgcgagccugcggucccucguggccucguccggcacgcuggaguucaucaacgagggguucaacuggaccggcgucacccagagcgggggcuccuacacgugcaagcgcgggagcgugaacuccuucuucucgcggcugaacuggcucuacgaguccgaguacaaguaccccgcccugaacgugaccaugcccaacaacggcaaguucgacaagcuguacaucuggggcguccaccaccccagcaccgagaaggagcagaccaaccucuacgugcgcgccuccgggcgggugaccgucagcacgaagcgcagccagcagaccgugaucccgaacaucggcuccucgcccugggugcgggggcuguccagccgcaucuccaucuacuggaccaucgucaagcccggcgacauccugcucaucaacagcaccggcaaccugaucgcgccccggggguacuucaagauccgcacgggcaaguccucgaucaugcgguccgacgccccgaucgggaccugcagcuccgagugcaucacccccaacggcagcauccccaacgacaagcccuuccagaacgugaacaagaucaccuacggggccugcccgcgcuacgugaagcagaacacgcugaagcucgccaccggcaugcggaacguccccgagaagcagacccgcggcaucuucggggccaucgcgggcuucaucgagaacgggugggagggcaugguggacgggugguacggcuuccggcaccagaacuccgagggcaccgggcaggccgccgaccugaaguccacgcaggccgccaucgaccagaucaacggcaagcugaaccgccucaucgagaagaccaacgagaaguuccaccagaucgagaaggaguucuccgagguggaggggcggauccaggaccuggagaaguacgucgaggacaccaagaucgaccuguggucguacaacgcggagcuccugguggcccuggagaaccaguacaccaucgaccucacggacuccgagaugaacaagcuguucgagaagacccgcaagcagcugcgggagaacgccgaggacaugggcaacgggugcuucaagaucuaccacaagugcgacaacgccugcaucggcagcauccgcaacggcaccuacgaccacgacguguaccgcgacgaggcccucaacaaccgguuccagaucaagggggucgagcugaaguccggcuacaaggacuggauccuguggaucagcuucgcgaucagcugcuuccuccugugcgugguccugcucggguucaucaugugggccugccagaagggcaacauccgcugcaacaucugcaucuga

SEQ ID NO: 9351 - RNA, 1701 nt, Artificial Sequence
  derived and/or modified CDS sequence (AUadapt) from InfluenzaA__AFM72098__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgucgcugcggucccucgucgccagcuccggcacgcuggaguucaucaacgaggacuucaacuggaccggggugacccagucgggcggguccuacgccugcaagcgcggcagcgugaacuccuucuucagccggcugaacuggcucuacaaguccgaguacaaguaccccgcccugaacgucaccaugcccaacaacgggaaguucgacaagcuguacaucuggggcgugcaccaccccgugacggaccgcgagcagaccaaccucuacguccgggcgucgggccgcgugaccguguccaccaagcggagccagcagacggucaucccgaacaucgggagccgccccugggugcggggccuguccucgcgcaucuccaucuacuggaccaucgugaagcccggggacauccugcucaucaacagcaccggcaaccugaucgcgccccggggcuacuucaagauccgcaccgggaaguccucgaucaugcgguccgacgccccgaucggcacgugcagcuccgagugcaucacccccaacgggagcauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgccggguucaucgagaacggcugggaggggauggucgacggcugguacggguuccggcaccagaacuccgagggcaccggccaggccgccgaccugaaguccacccaggccgcgaucgaccagaucaacgggaagcugaaccgccucaucgagaagacgaacgagaaguuccaccagaucgagaaggaguucuccgagguggagggccggauccaggaccuggagaaguacguggaggacaccaagaucgaccuguggucguacaacgccgagcuccuggucgcccuggagaaccagcacaccaucgaccucaccgacuccgagaugaacaagcuguucgagaagacgcgcaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaagggcgucgagcugaaguccggguacaaggacuggauccuguggaucagcuucgccaucuccugcuuccuccugugcguggugcugcucggcuucaucaugugggccugccagaaggggaacauccgcugcaacaucugcaucuga

SEQ ID NO: 9352 - RNA, 1701 nt, Artificial Sequence
  derived and/or modified CDS sequence (AUadapt) from InfluenzaA__AFM72109__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccagcuccggcacgcuggaguucaucaacgaggacuucaacuggaccggggugacccagucgggcggguccuacgccugcaagcgcggcagcgugaacuccuucuucucgcggcugaacuggcuccacaaguccgaguacaaguaccccgcccugaacgucaccaugcccaacaacgggaaguucgacaagcuguacaucuggggcgugcaccaccccaucacggaccgcgagcagaccaaccucuacgugcgggcgagcggccgcgucaccguguccaccaagcggucgcagcagacggugaucccgaacaucgggagccgccccuggguccggggccuguccagccgcaucuccaucuacuggaccaucgugaagcccggggacauccugcucaucaacucgaccggcaaccugaucgcgccccggggcuacuucaagauccgcaccgggaaguccagcaucaugcgguccgacgccccgaucggcacgugcucguccgagugcaucacccccaacgggagcauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacuccgagggcaccggccaggccgccgaccugaaguccacccaggccgcgaucgaccagaucaacgggaagcugaaccgccucaucgagaagacgaacgagaaguuccaccagaucgagaaggaguucuccgaggucgagggccggauccaggaccuggagaaguacguggaggacaccaagaucgaccuguggucguacaacgccgagcuccugguggcccuggagaaccagcacaccaucgaccucaccgacuccgagaugaacaagcuguucgagaagacgcgccgccagcugcgggagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaagggcguggagcugaaguccggguacaaggacuggauccuguggaucagcuucgccaucuccugcuuccuccugugcgucgugcugcucggcuucaucaugugggccugccagaaggggaacauccggugcaacaucugcaucuga

SEQ ID NO: 9353 - RNA, 1701 nt, Artificial Sequence
  derived and/or modified CDS sequence (AUadapt) from InfluenzaA__AFM72120__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgucgcugcggucccucgucgccagcuccggcacgcuggaguucaucaacgaggacuucaacuggaccggggugacccagucgggcggguccuacgccugcaagcgcggcagcgugaacuccuucuucagccggcugaacuggcuccacgaguccgaguacaaguaccccgcccugaacgucaccaugcccaacaacgggaaguucgacaagcuguacaucuggggcgugcaccaccccaucacggaccgcgagcagaccaaccucuacgugcgggcgucgggccgcgucaccguguccaccaagcggagccagcagacggugaucccgaacaucggguuccgccccuggguccggggccugagcucccgcaucucgaucuacuggaccaucgugaagcccggggacauccugcucaucaacuccaccggcaaccugaucgcgccccggggcuacuucaagauccgcaacggcaagagcuccaucaugcggucggacgccccgaucgggaccugcuccagcgagugcaucacgcccaacggguccauccccaacgacaagcccuuccagaacgugaacaagaucaccuacggcgccugcccgcgcuacgucaagcagaacacccugaagcucgccaccgggaugcggaacgugcccgagaagcagacgcgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagaccaacgagaaguuccaccagaucgagaaggaguucucggaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgcgagaacgccgaggacauggggaacggcugcuucaagaucuaccacaagugcgacaacgccugcaucggguccauccggaacggcacguacgaccacgacgucuaccgcgacgaggcgcucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 9354 - RNA, 1701 nt, Artificial Sequence
  derived and/or modified CDS sequence (AUadapt) from InfluenzaA__AFM72131__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaaggacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaacgggguggcccagagcggcgaguccuacgccugcaagcgcgggucggugaaguccuucuucagccggcucaacuggcugcacgaguccgaguacaaguaccccgcgcugaacgucaccaugcccaacaacggcaaguucgacaagcucuacaucuggggcgugcaccaccccucgaccgaccgcgagcagaccaagcuguacgugcgggccuccgggcgcgucacggugagcaccaagcggucgcagcagaccgugaucccgaacaucggcucccgccccuggguccgggggcugagcucccgcaucucgaucuacuggaccaucgugaagcccggcgacauccuccugaucaacuccacggggaaccugaucgcgccccggggcuacuucaagauccgcaccggcaagagcuccaucaugcggucggacgccccgaucgggaccugcuccagcgagugcaucacccccaacggcuccauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacucggaggggacgggccaggccgccgaccugaaguccacccaggcggccaucgaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacucggagaugaacaagcuguucgagaagacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcugaaguccggcuacaaggacuggauccucuggaucuccuucgccaucagcugcuuccugcugugcgucgugcuccugggguucaucaugugggccugccagaagggcaacauccggugcaacaucugcaucuga

SEQ ID NO: 9355 - RNA, 1701 nt, Artificial Sequence
  derived and/or modified CDS sequence (AUadapt) from InfluenzaA__AFM72142__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaucaacgaggacuucaacuggaccgggguggcccaggacggcggguccuacgccugcaagcgcggcucggugaacuccuucuucagccggcugaacuggcuccacaagcuggaguacaaguaccccgcgcugaacgucaccaugcccaacaacgggaaguucgacaagcucuacaucuggggcgugcaccaccccuccaccgaccgcgaccagacgucgcuguacgugcgggccuccggccgcgucaccgugagcaccaagcggucgcagcagaccgugaucccgaacaucgggucccgccccuggguccggggccagucgucccgcaucagcaucuacuggacgaucgugaagcccggggacauccugcucaucaacuccaccggcaaccugaucgcgccccggggcuacuucaagauccgcaacggcaagucguccaucaugcggagcgacgccccgaucgggaacugcuccucggagugcaucacccccaacggguccauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccugaaguccacgcaggcggccaucgaccagaucaacgggaagcugaaccggcucaucgagaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagcgcacccggaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaagggcguggagcucaagucgggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 9356 - RNA, 1701 nt, Artificial Sequence
  derived and/or modified CDS sequence (AUadapt) from InfluenzaA__AFM72153__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcggcucgccccaccggauccuggacgggaagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaucaacgaggacuucaacuggaccggcguggcccaggacgggggcucguacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggcgggucaccgugagcaccaagcgcucgcagcagaccgugacgccgaacaucggcucccggcccuggguccgcgggcagagcucccggaucggcaucuacuggaccaucgugaagcccggcgacauccuccugaucaacucgaccgggaaccugaucgcgccccgcggcuacuucaagauccggaacgggaaguccucgaucaugcgcuccgacgccccgaucggcaacugcagcuccgagugcaucacccccaacgggucgauccccaacgacaagcccuuccagaacgugaaccggaucacguacggcgccugcccgcgcuacgucaagcagaacacccucaagcuggccaccggcaugcggaacgugcccgagaagcagacccgcgggaucuucggcgccaucgccggguucaucgagaacggcugggaggggaugguggacggcugguacggcuuccggcaccagaacuccgaggggacgggccaggccgccgaccugaaguccacccaggcggccaucgaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagacccgcaagcagcuccgcgagaacgccgaggacauggggaacggcugcuucaagaucuaccacaagugcgacaacgcgugcaucggcucgauccggaacgggaccuacgaccacgacgucuaccgcgacgaggcccugaacaaccgguuccagaucaagggcguggagcugaaguccggguacaaggacuggauccucuggaucagcuucgccaucuccugcuuccugcugugcgucgugcuccugggcuucaucaugugggccugccagaagggcaacauccgcugcaacaucugcaucuga

SEQ ID NO: 9357 - RNA, 1701 nt, Artificial Sequence
  derived and/or modified CDS sequence (AUadapt) from InfluenzaA__AFM72164__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucgucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacucgaacugcuacccguacgacgugcccgacuacgcgucccuccggagccuggucgccuccucgggcacgcuggaguucaucaacgagaacuucaacuggaccgggguggcccaggacggcaaguccuacgccugcaagcgcgggagcgugaacuccuucuucucgcggcucaacuggcugcacaagcuggaguacaaguaccccgcgcucaacgucaccaugcccaacaacggcaaguucgacaagcuguacaucuggggcgugcaccacccguccaccgacucggaccagacgucccuguacgugcgcgccagcgggcgggucaccguguccaccaagcgcucgcagcagaccgugauccccgacaucggcuaccggcccuggguccgcgggcagagcucccggaucucgauccacuggacgaucgugaagcccggcgacauccuccugaucaacuccaccgggaaccugaucgccccgcgcggcuacuucaagauccggaacggcaagagcuccaucaugcgcucggacgcccccaucgggaacugcuccucggagugcaucacccccaacggcuccauccccaacgacaagccguuccagaacgugaaccggaucaccuacggggccugcccccgcuacgucaagcagaacacgcucaagcuggcgaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccugaaguccacgcaggcggccaucgaccagaucaacggcaagcucaaccgccuggucgagaagaccaacgagaaguuccaccagaucgagaaggaguucucggagguggaggggcggauccaggaccuggagaaguacguggaggacaccaagaucgaccucugguccuacaacgccgagcugcuggucgcccucgagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagucgggcuacaaggacuggauccuguggaucuccuucgccaucagcugcuuccugcugugcguggugcuccugggguucaucaugugggccugccagaagggcaacauccggugcaacaucugcaucuga

SEQ ID NO: 9358 - RNA, 1701 nt, Artificial Sequence
  derived and/or modified CDS sequence (AUadapt) from InfluenzaA__AFM72175__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucgucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacucgaacugcuacccguacgacgugcccgacuacgcgucccuccggagccuggucgccuccucgggcacgcuggaguucaucaacgagaacuucaacuggaccgggguggcccaggacggcaaguccuacgccugcaagcgcgggucggugaacuccuucuucagccggcucaacuggcugcacaagcuggaguacaaguaccccgcgcucaacgucaccaugcccaacaacggcaaguucgacaagcuguacaucuggggcgugcaccacccguccaccgacucggaccagacgaaccuguacgugcgcgccuccgggcgggucaccgugagcaccaagcgcucccagcagaccgugauccccgacaucggcuaccggcccuggguccgcgggcagucgucgcggaucuccauccacuggacgaucgugaagcccggcgacauccuccugaucaacagcaccgggaaccugaucgccccgcgcggcuacuucaagauccggaacggcaaguccucgaucaugcgcuccgacgcccccaucgggaacugcagcuccgagugcaucacccccaacggcucgauccccaacgacaagccguuccagaacgugaaccggaucaccuacggggccugcccccgcuacgucaagcagaacacgcucaagcuggcgaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagucgacgcaggcggccaucgaccagaucaacggcaagcugaaccgccuggucgagaagaccaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacaccaucgaccugacggacuccgagaugaacaagcuguucgagcgcacccgcaagcagcuccgggagaacgccgaggacaugggcaacgggugcuucaagaucuaccacaagugcgacaacgcgugcaucggcucgauccgcaacgggaccuacgaccacgacguguaccgggacgaggcccugaacaaccgcuuccagaucaagggcgucgagcugaaguccggcuacaaggacuggauccucuggaucagcuucgccaucuccugcuuccugcugugcguggugcuccugggguucaucaugugggccugccagaagggcaacauccggugcaacaucugcaucuga

SEQ ID NO: 9359 - RNA, 1701 nt, Artificial Sequence
  derived and/or modified CDS sequence (AUadapt) from InfluenzaA__AFM72197__HA
augaagaccaucaucgcccugucguacauccucugcaugguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccagcuccggcacgcuggaguucaacaacgagucguucaacuggaccgggguggcccagaacggcaccuccuacgccugcaagcgccggagcgugaaguccuucuucucgcgccugaacuggcuccacaagcuggaguacaaguaccccgcgcugaacgucaccaugcccaacaacgacaaguucgacaagcucuacaucuggggcgugcaccaccccaucacggacuccgagcagaccagccuguacgugcaggccuccgggcgggucaccgugucgaccaagcgcagccagcagacggugaucccgaacaucggguaccggcccuggguccgcggcguguccagccggaucuccaucuacuggaccaucgugaagcccggcgacauccugcucaucaacucgaccgggaaccugaucgcgccccgcggcuacuucaagauccgguccgggaaguccuccaucaugcgcagcgacgccccgaucggcaacugcaacuccgagugcaucacccccaacggcucgauccccaacgacaagcccuuccagaacgucaaccggaucacguacggggccugcccgcgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacuccgaggggacgggccaggccgccgaccucaagagcacccaggcggccaucaaccagaucaacgggaagcugaaccgccugaucgagaagaccaacgagaaguuccaccagaucgagaaggaguucuccgagguggagggccggauccaggaccuggagaaguacguggaggacaccaagaucgaccuguggucguacaacgccgagcuccuggucgcccuggagaaccagcacacgaucgaccucaccgacuccgagaugaacaagcuguucgagcgcacccgcaagcagcugcgggagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcguggugcugcucggcuucaucaugugggccugccagaagggcaacaucaagugcaacaucugcaucuga

SEQ ID NO: 9360 - RNA, 1701 nt, Artificial Sequence
  derived and/or modified CDS sequence (AUadapt) from InfluenzaA__AFM72208__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaucaacucguucuucucccggcucaacuggcugcaccagcugaaguaccgcuaccccgcgcucaacgugaccaugcccaacaacgacaaguucgacaagcuguacaucuggggcguccaccaccccagcacggacuccgaccagaccucgcuguacacccaggccagcgggcgggugaccguguccacgaagcgcucgcagcagaccgucaucccgaacaucgggucccggcccugggugcgcggcaucagcucccggaucucgaucuacuggaccaucgugaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacgcccaacggcuccauccccaacgacaagcccuuccagaacgucaaccggaucaccuacggggccugcccgcgcuacgugaagcagaacacccucaagcuggccaccggcaugcggaacgugcccgagaagcagacgcgcgggaucuucggcgccaucgccggguucaucgagaacggcugggagggcaugauggacgggugguacggcuuccggcaccagaacucggaggggaccggccaggccgccgaccugaaguccacccaggcggccaucaaccagaucaacgggaagcucaaccgccugaucgagaagaccaacgagaaguuccaccagaucgagaaggaguucagcgaggucgagggccggauccaggaccuggagaaguacguggaggacacgaagaucgaccucugguccuacaacgccgagcugcugguggcccucgagaaccagcacaccaucgaccugaccgacucggagaugaacaagcuguucgagcgcacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 9361 - RNA, 1701 nt, Artificial Sequence
  derived and/or modified CDS sequence (AUadapt) from InfluenzaA__AFM72219__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaucaacucguucuucucccggcucaacuggcugcaccagcugaaguaccgcuaccccgcgcucaacgugaccaugcccaacaacgacaaguucgacaagcuguacaucuggggcguccaccaccccagcacggacuccgaccagaccucgcuguacacccaggccagcgggcgggugaccguguccacgaagcgcucgcagcagaccgucaucccgaacaucgggucccggcccugggugcgcggcaucagcucccggaucucgaucuacuggaccaucgugaagcccggcgacauccuccugaucaaguccaccgggaaccugaucgcgccccgcggcuacuucaagauccggagcgggaaguccucgaucaugcgcuccgacgccccgaucggcaagugcaacagcgagugcaucacgcccaacggcuccauccccaacgacaagcccuuccagaacgucaaccggaucaccuacggggccugcccgcgcuacgugaagcagaacacccucaagcuggccaccggcaugcggaacgugcccgagaagcagacgcgcgggaucuucggcgccaucgccggguucaucgagaacggcugggagggcaugauggacgggugguacggcuuccggcaccagaacucggaggggaccggccaggccgccgaccugaaguccacccaggcggccaucaaccagaucaacgggaagcucaaccgccugaucgagaagaccaacgagaaguuccaccagaucgagaaggaguucagcgaggucgagggccggauccaggaccuggagaaguacguggaggacacgaagaucgaccucugguccuacaacgccgagcugcugguggcccucgagaaccagcacaccaucgaccugaccgacucggagaugaacaagcuguucgagcgcacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 9362 - RNA, 1698 nt, Artificial Sequence
  derived and/or modified CDS sequence (AUadapt) from InfluenzaA__AFM72230__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagaaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgugaacaacaaggagaaggaggugcucguccuguggggcgugcaccacccgcccaacaucgggaaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 9363 - RNA, 1701 nt, Artificial Sequence
  derived and/or modified CDS sequence (AUadapt) from InfluenzaA__AFM72246__HA
augaagaccaucaucgcccugucguacauccucugccugguguucgcccagaagcugcccggcaacgacaacuccaccgcgacgcucugccuggggcaccacgccgucagcaacggcacccuggugaagaccaucaccaacgaccagaucgaggugacgaacgccaccgagcucguccaguccucguccaccgggcgcaucugcgacagcccgcaccagauccuggacggcgagaacugcacccugaucgacgcccuccugggggacccccacugcgacggcuuccagaacaaggagugggaccuguucguggagcgguccaaggccuacucgaacugcuaccccuacgacgugcccgacuacgcgucccuccgcagccuggucgccuccucgggcacgcuggaguucaacaacgaguccuucaacuggaccgggguggcccagaacggcaccagcuccgccugcaagcggcgcucgaacaaguccuucuucagccggcucaacuggcugcaccagcugaaguacaaguacccggcgcucaacgugaccaugcccaacaacgagaaguucgacaagcuguacaucuggggcguccaccaccccuccacggacucggaccagaucagcaucuacgcccaggccuccgggcgcgugaccgugagcaccaagcggucccagcagaccgucauccccaacaucgggucguccccgugggugcgcggcgugagcucccggaucucgaucuacuggacgaucgucaagcccggcgacauccugcucaucaacuccaccgggaaccugaucgcgccccgcggcuacuucaagauccggagcgggaaguccucgaucaugcgcuccgacgcccccaucggcaagugcaacagcgagugcaucaccccgaacggcuccauccccaacgacaagcccuuccagaacgugaaccggaucaccuacggggccugcccccgcuacgugaagcagaacacgcugaagcucgccaccggcaugcggaacgucccggagaagcagacccgcgggaucuucggcgccaucgccggguucaucgagaacggcugggagggcaugguggacgggugguacggcuuccggcaccagaacucggaggggaccggccaggccgcggaccugaaguccacgcaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagcgcaccaagaagcagcugcgggagaacgcggaggacaugggcaacgggugcuucaagaucuaccacaagugcgacaacgccugcaucggcagcauccgcaacgggaccuacgaccacgacguguaccgcgacgaggcccucaacaaccgguuccagaucaagggcgucgagcugaaguccggguacaaggacuggauccuguggaucagcuucgccaucuccugcuuccuccugugcgugguccugcucggcuucaucaugugggccugccagaagggcaacauccgcugcaacaucugcaucuga

SEQ ID NO: 9364 - RNA, 1701 nt, Artificial Sequence
  derived and/or modified CDS sequence (AUadapt) from InfluenzaA__AFM72257__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaacuacaaguaccccgcgcucaacgucacgaugcccaacaacgagaaguucgacaagcuguacaucuggggcgugcaccaccccagcaccgacuccgaccagaucucgaucuacgcccaggccagcgggcgcgugaccgucuccaccaagcggucgcagcagacggugaucccgaacaucggcucccgccccugggugcgcggggucagcuccggcaucagcaucuacuggaccaucgugaagcccggcgacauccugcucaucaacuccaccgggaaccugaucgcgccccggggcuacuucaagauccggucggggaaguccagcaucaugcgcuccaacgccccgaucggcaagugcaacucggagugcaucacccccaacggcuccauccccaacgacaagcccuuccagaacgugaaccggaucacguacggggccugcccgcgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacgggugcuucaagaucuaccacaagugcgacaacgccugcaucggcuccauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagaagggcaacauccggugcaacaucugcaucuga

SEQ ID NO: 9365 - RNA, 1701 nt, Artificial Sequence
  derived and/or modified CDS sequence (AUadapt) from InfluenzaA__AFM72268__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaacuacaaguaccccgcgcucaacgucacgaugcccaacaacgagaaguucgacaagcuguacaucuggggcgugcaccaccccaacaccgacucggaccagaucuccaucuacgcccaggccagcgggcgcgugaccgucucgaccaagcggucccagcagacggugaucccgaacaucggcagccgccccugggugcgcggggucuccucgggcaucuccaucuacuggaccaucgugaagcccggcgacauccugcucaucaacagcaccgggaaccugaucgcgccccggggcuacuucaagauccgguccgggaaguccuccaucaugcgcucgaacgccccgaucggcaagugcaacuccgagugcaucacccccaacggcagcauccccaacgacaagcccuuccagaacgugaaccggaucacguacggggccugcccgcgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggacgggccaggccgcggaccucaagucgacccaggccgccaucaaccagaucaacgggaagcugaaccgccugaucgagaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcacccggaagcagcugcgcgagaacgcggaggacaugggcaacgggugcuucaagaucuaccacaagugcgacaacgccugcaucggcucgauccgcaacgggaccuacgaccacgacgucuaccgggacgaggcccucaacaaccgcuuccagaucaagggcguggagcugaaguccggguacaaggacuggauccuguggaucagcuucgccaucagcugcuuccuccugugcgucgugcugcucggcuucaucaugugggccugccagaagggcaacauccggugcaacaucugcaucuga

SEQ ID NO: 9366 - RNA, 1701 nt, Artificial Sequence
  derived and/or modified CDS sequence (AUadapt) from InfluenzaA__AFM72279__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgaucuacgcccaggccagcgggcgcgugaccgucuccaccaagcggucgcagcagacggugaucccgaacaucggcuccaagcacugggugcgcggggucagcucccggaucagcaucuacuggaccaucgugaagcccggcgacauccugcucaucaacuccaccggcaaccugaucgcgccccgcggguacuucaagauccggucgggcaaguccagcaucaugcgcuccaacgcccccaucgggaagugcaacucggagugcaucaccccgaacggcuccauccccaacgacaagcccuuccagaacgugaaccggaucacguacggcgccugcccccgcuacgucaagcagaacacccugaagcucgccaccgggaugcggaacgugccggagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcugaaccgccucaucgagaagaccaacgagaaguuccaccagaucgagaaggaguucucggaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggguucaucaugugggccugccagaagggcaacauccggugcaacaucugcaucuga

SEQ ID NO: 9367 - RNA, 1701 nt, Artificial Sequence
  derived and/or modified CDS sequence (AUadapt) from InfluenzaA__AFM72290__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaggacaaguaccccgcgcucaacgucacgaugcccaacaacgagaaguucgacaagcuguacaucuggggcgugcaccaccccucgaccgacuccgaccagaucagcaucuacgcccaggccucggggcgcgugaccgucuccaccaagcggagccagcagacggugaucccgaacaucggcuccaagcacugggugcgcggggucucgucccggaucagcaucuacuggaccaucgugaagcccggcgacauccugcucaucaacuccaccggcaaccugaucgcgccccgcggguacuucaagauccggucgggcaaguccagcaucaugcgcuccaacgcccccaucgggaagugcaacucggagugcaucaccccgaacggcuccauccccaacgacaagcccuuccagaacgugaaccggaucacguacggcgccugcccccgcuacgucaagcagaacacccugaagcucgccaccgggaugcggaacgugccggagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcugaaccgccucaucgagaagaccaacgagaaguuccaccagaucgagaaggaguucucggaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggguucaucaugugggccugccagaagggcaacauccggugcaacaucugcaucuga

SEQ ID NO: 9368 - RNA, 1701 nt, Artificial Sequence
  derived and/or modified CDS sequence (AUadapt) from InfluenzaA__AFM72301__HA
augaagaccaucaucgcccugucguacauccucugccugguguucucccagaagcugcccggcaacgacaacucgaccgccacgcucugccuggggcaccacgcggucccgaacggcaccaucgugaagaccaucaccaacgaccagaucgaggugacgaacgccaccgagcugguccaguccagcuccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgccucccugcggucgcucgucgcguccagcgggacgcuggaguucaacaacgaguccuucaacugggccggcgugacccagaacgggaccucguccgccugcaagcgccggucgaacaaguccuucuucagccgccugaacuggcucacccagcugaaguacaaguaccccgcccugaacgugacgaugcccaacaacgagaaguucgacaagcucuacaucuggggcguccaccaccccgugaccgacuccgaccagaucucgcuguacgcgcaggccagcgggcggaucaccguguccaccaagcgcucgcagcagacggucaucccgaacaucggcuaccggccccgcgugcgggacaucuccagccgcaucuccaucuacuggaccaucgugaagcccggcgacauccugcucaucaacucgaccgggaaccugaucgcgccccggggcuacuucaagauccgcuccggcaagucguccaucaugcggagcgacgccccgaucgggaagugcaacuccgagugcaucacccccaacggcucgauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggucguacaacgccgagcuccuggucgcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgagagcauccgcaacgggaccuacgaccacgacguguaccgggacgaggcccucaacaaccgcuuccagaucaagggcguggagcugaaguccggguacaaggacuggauccuguggaucucguucgccaucagcugcuuccuccugugcgucgcccugcucggcuucaucaugugggccugccagaagggcaacauccggugcaacaucugcaucuga

SEQ ID NO: 9369 - RNA, 1701 nt, Artificial Sequence
  derived and/or modified CDS sequence (AUadapt) from InfluenzaA__AFM72312__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgugaccgacucggaccagaucaaccuguacgcgcaggccuccgggcggaucaccgugagcacgaagcgcucgcagcagaccgucaucccgaacaucggcuaccggccccgcgugcgggacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 9370 - RNA, 1701 nt, Artificial Sequence
  derived and/or modified CDS sequence (AUadapt) from InfluenzaA__AFM72323__HA
augaaggccaucaucgcccugucguacauccucugccugguguucgcgcagaagcugcccggcaacgacaacuccaccgccacccucugccuggggcaccacgccgucccgaacggcacgaucgugaagaccaucaccaacgaccagaucgaggugaccaacgccacggagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggcguacuccaacugcuaccccuacgacgugccggacuacgccucgcugcggucccucgucgccagcuccgggacccuggaguucaacaacgagucguucaacuggacgggcgugacccagaacgggaccuccucggccugcaagcgccgguccaacaagucguucuucucccgccugaacuggcucacccaccugaaguacaaguaccccgcgcugaacgugacgaugcccaacaacgagaaguucgacaagcucuacaucuggggcguccaccaccccgugaccgacagcgaccagaucaaccuguacgcccaggccuccgggcggaucaccgugucgaccaagcgcucgcagcagacggucaucccgaacaucggcuaccggccccgcgugcgggacaaccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacucggagugcaucacccccaacggcuccauccccaacgacaagccguuccagaacgucaaccgcaucacguacggggcgugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggacgggccaggccgcggaccugaaguccacccaggccgccaucaaccagaucaacgggaagcugaaccggcucaucggcaagaccaacgagaaguuccaccagaucgagaaggaguucucggagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagcggaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 9371 - RNA, 1701 nt, Artificial Sequence
  derived and/or modified CDS sequence (AUadapt) from InfluenzaA__AFM72334__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccugcaccccgggaccuacaaggaccagaucuuccuguacgcgcaggccagcgggcggaucaccguguccacgaagcgcucgcagcaggccgugaucccgaacaucggcagccggccccgcguccggaacauccccucccgcgugucgaucuacuggaccaucgugaagcccggcgacauccuccugaucaacuccaccgggaaccugaucgccccgcggggcuacuucaagauccgcagcgggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacaccaucgaccugacggacucggagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 9372 - RNA, 1701 nt, Artificial Sequence
  derived and/or modified CDS sequence (AUadapt) from InfluenzaA__AFM72345__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgugaccgacagcgaccagaucucccuguacacccaggcgucggggcggaucacggugucgaccaagcgcucccagcagaccgucaucccgaacaucggcuuccggccccgcgugcgggacaucagcucccgcaucucgaucuacuggaccaucgugaagcccggcgacauccugcucaucaacuccacggggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacucggaggggaccggccaggccgccgaccugaaguccacccaggccgcgaucaaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagcggacgaagaagcagcugcgcgagaacgccgaggacauggggaacggcugcuucaagaucuaccacaagugcgacaacgccugcaucggguccauccgcaacggcaccuacgaccacgacguguaccgggacgaggcgcucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 9373 - RNA, 1701 nt, Artificial Sequence
  derived and/or modified CDS sequence (AUadapt) from InfluenzaA__AFM72356__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucaaccuguacgugcaggcgagcggccggaucaccguguccacgaagcgcucgcagcagaccgucaucccgaacaucggcucgcggccccgcgugcgggacgugcccucccgcaucagcaucuacuggaccaucgucaagcccggggacauccugcucaucuccucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgugaagcagaacacccugaagcucgccaccgggaugcgcaacguccccgagaagcagacgcggggcaucuucggggcgaucgccggcuucaucgagaacggcugggaggggaugguggacggcugguacggguuccgccaccagaacuccgagggcaccgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggacguacgaccacgacguguaccgggacgaggcgcucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 9374 - RNA, 1701 nt, Artificial Sequence
  derived and/or modified CDS sequence (AUadapt) from InfluenzaA__AFM72367__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgugaccgacaacgaccagaucaaccuguacgcgcaggccagcgggcggaucaccguguccacgaagcgcucgcagcagaccgucaucccgaacaucggcucgcggccccgcgugcgggacgugcccucccgcaucagcaucuacuggaccaucgucaagcccggcgacauccugcucaucuccucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccucaagucgacccaggcggccaucaaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcacguacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9375 - RNA, 1701 nt, Artificial Sequence
  derived and/or modified CDS sequence (AUadapt) from InfluenzaA__AFM72378__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcagcugaacuucaaguaccccgcccugaacgugaccaugcccaacaacgagcaguucgacaagcucuacaucuggggcguccaccaccccgugaccgacaaggaccagaucuuccuguacgcgcaggccucggggcggaucaccguguccacgaagcgcagccagcaggccgucaucccgaacaucggguaccggccccgcgugcggaacauccccucgcgcguguccaucuacuggaccaucgucaagcccggcgacauccugcucaucaacagcaccggcaaccugaucgccccgcggggguacuucaagauccgcuccggcaagucguccaucaugcggagcgacgcccccaucgggaagugcaacuccgcgugcaucacccccaacggcucgauccccaacgacaagccguuccagaacgugaaccgcaucacguacggcgccugcccccgguacgugaagcagaacacccugaagcucgccaccgggaugcgcaacguccccgagaagcagacccggggcaucuucggggccaucgccggcuucaucgagaacgggugggagggcaugguggacggcugguacggguuccgccaccagaacuccgagggccgggggcaggcggccgaccugaaguccacgcaggccgccaucgaccagaucaacggcaagcugaaccgccucaucgggaagaccaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgccugcaucggcucgauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcguggcgcugcucggcuucaucaugugggccugccagaagggcaacauccggugcaacaucugcaucuga

SEQ ID NO: 9376 - RNA, 1701 nt, Artificial Sequence
  derived and/or modified CDS sequence (AUadapt) from InfluenzaA__AFM72389__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgugaccgacaaggaccagaucuuccuguacgcgcaggccucggggcggaucaccguguccacgaagcgcucgcagcaggccgucaucccgaacaucggguaccggccccgcgugcggaacaaccccagccgcguguccaucuacuggaccaucgucaagcccggcgacauccugcucaucaacucgaccggcaaccugaucgccccgcggggguacuucaagauccgcuccggcaagagcuccaucaugcggucggacgcccccaucgggaagugcaacuccgcgugcaucacccccaacggcucgauccccaacgacaagccguuccagaacgugaaccgcaucacguacggcgccugcccccgguacgugaagcagaacacccugaagcucgccaccgggaugcgcaacguccccgagaagcagacccggggcaucuucggggccaucgccggcuucaucgagaacgggugggagggcaugguggacggcugguacggguuccgccaccagaacuccgagggccgggggcaggcggccgaccugaaguccacgcaggccgccaucgaccagaucaacggcaagcugaaccgccucaucgggaagaccaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgccugcaucggcucgauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcguggcgcugcucggcuucaucaugugggccugccagaagggcaacauccggugcaacaucugcaucuga

SEQ ID NO: 9377 - RNA, 1701 nt, Artificial Sequence
  derived and/or modified CDS sequence (AUadapt) from InfluenzaA__AFM72400__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacugggccggggugacccagaacggcaccuccucggccugcaagcgcggguccaacaacagcuucuucucccggcugaacuggcucacccacucgaaguucaaguaccccgcgcugaacgugacgaugcccaacaacgaggaguucgacaagcuguacaucuggggcguccuccaccccgggaccgacaacgaccagaucuuccuguacgcccaggccuccggccgcaucaccgugagcaccaagcggucgcagcagacggugaucccgaacaucggcucccgcccccggguccgcaacauccccagccggaucuccaucuacuggaccaucgugaagcccggggacauccugcucaucaacucgaccggcaaccugaucgccccgcgcggguacuucaagauccgguccggcaagagcuccaucaugcgcucggacgcccccaucggcaagugcaacuccgagugcaucacccccaacgggagcauccccaacgacaagccguuccagaacgugaaccggaucacguacggcgcgugcccccgcuacgucaagcagaacacccugaagcucgccaccgggaugcggaacgugcccgagaagcagacccgcggcaucuucggggccaucgccggcuucaucgagaacggcugggaggggaugguggacggcugguacggguuccggcaccagaacuccgagggcaucgggcaggccgcggaccugaaguccacgcaggccgccaucgaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggucguacaacgccgagcuccugguggcccuggagaaccagcacaccaucgaccucacggacuccgagaugaacaagcuguucgagaagaccaagaagcagcugcgcgagaacgcggaggacaugggcaacgggugcuucaagaucuaccacaagugcgacaacgccugcaucggcagcauccggaacgggaccuacgaccacgacgucuaccgcgacgaggcccucaacaaccgcuuccagaucaagggcguggagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 9378 - RNA, 1701 nt, Artificial Sequence
  derived and/or modified CDS sequence (AUadapt) from InfluenzaA__AFM72411__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccagcuccggcacgcuggaguucaacaacgagucguucaacugggccggggugacccagaacggcaccuccagcgccugcaagcgcggguccaacaacucguucuucucccggcugaacuggcucacccagagcaaguucaaguaccccgcgcugaacgugacgaugcccaacaacgaggaguucgacaagcuguacaucuggggcguccaccaccccgugaccgacaacgaccagaucuuccucuacgcccaggccuccgggcgcaucaccgugucgaccaagcggagccagcagacggucaucccgaacaucggcucccgcccccgggugcgcaacauccccagccggaucuccaucuacuggaccaucgugaagcccggcgacauccugcugaucaacucgaccgggaaccucaucgccccgcgcggcuacuucaagauccgguccgggaaguccuccaucaugcgcagcgacgcccccaucggcaagugcaacuccgagugcaucacccccaacggcucgauccccaacgacaagccguuccagaacgucaaccggaucacguacggggcgugcccccgcuacgugaagcagaacacccugaagcuggccaccggcaugcggaacgugcccgagaagcagacccgcgggaucuucggcgccaucgccggguucaucgagaacggcugggagggcauggucgacgggugguacggcuuccggcaccagaacuccgaggggaucggccaggccgcggaccucaagagcacgcaggccgccaucgaccagaucaacgggaagcugaaccgccugaucggcaagaccaacgagaaguuccaccagaucgagaaggaguucuccgagguggagggccggauccaggacuucgagaaguacguggaggacaccaagaucgaccucuggucguacaacgccgagcugcuggucgcccucgagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacgacguguaccgcgacgaggcccugaacaaccgcuuccagaucaaggggguggagcugaaguccggcuacaaggacuggauccucuggaucagcuucgccaucuccugcuuccugcugugcgucgcccuccugggcuucaucaugugggcgugccagaaggggaacauccggugcaacaucugcaucuga

SEQ ID NO: 9379 - RNA, 1701 nt, Artificial Sequence
  derived and/or modified CDS sequence (AUadapt) from InfluenzaA__AFM72422__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgugaccgacaacgaccagaucuuccuguacgcgcaggccagcgggcggaucaccguguccacgaagcgcucgcagcagaccgucaucccgaacaucggguuccggccccgcgugcggaacauccccagccgcaucuccaucuacuggaccaucgugaagcccggcgacauccugcucaucaacucgaccggcaaccugaucgccccgcggggguacuucaagauccgcuccggcaagagcuccaucaugcggucggacgcccccaucgggaagugcaacuccgagugcaucacgcccaacggcagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcugaaccggcucaucgggaagaccaacgagaaguuccaccagaucgagaaggaguucuccgagguggagggccgcauccaggaccuggagaaguacgccgaggacaccaagaucgaccuguggucguacaacgccgagcuccugguggcccuggagaaccagcacacgaucgaccucaccgacuccgagaugaacaagcuguucgagaagaccaagaagcagcugcgggagaacgcggaggacaugggcaacgggugcuucaagaucuaccacaagugcgacaacgccugcaucggcagcauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggcgugccagaagggcaacauccgcugcaacaucugcaucuga

SEQ ID NO: 9380 - RNA, 1701 nt, Artificial Sequence
  derived and/or modified CDS sequence (AUadapt) from InfluenzaA__AFM72433__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgugaccgacaacgaccagaucuuccuguacgcgcaggccucggggcggaucaccguguccacgaagcgcagccagcagaccgucaucccgaacaucggguuccggccccgcgugcggaacaaccccucgcgcaucuccaucuacuggaccaucgugaagcccggcgacauccugcucaucaacagcaccggcaaccugaucgccccgcggggguacuucaagauccgcuccggcaagucguccaucaugcggagcgacgcccccaucgggaagugcaacuccgagugcaucacgcccaacggcucgauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcugaaccggcucaucgggaagaccaacgagaaguuccaccagaucgagaaggaguucuccgagguggagggccgcauccaggaccuggagaaguacgccgaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacaugggcaacgggugcuucaagaucuaccacaagugcgacaacgccugcaucggcucgauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggcgugccagaagggcaacauccgcugcaacaucugcaucuga

SEQ ID NO: 9381 - RNA, 1701 nt, Artificial Sequence
  derived and/or modified CDS sequence (AUadapt) from InfluenzaA__AFM72444__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgaggaguucgacaagcucuacaucuggggcguccaccaccccgugaccgacaacgaccagauccugcuguacgcgcaggccucggggcggaucaccguguccacgaagcgcagccagcagaccgucaucccgaacaucggguuccggccccgcgugcggaacaaccccucgcgcaucuccaucuacuggaccaucgugaagcccggcgacauccuccugaucaacagcaccggcaaccugaucgccccgcggggguacuucaagauccgcuccggcaagucguccaucaugcggagcgacgcccccaucgggaagugcaacuccgagugcaucacgcccaacggcucgauccccaacgacaagccguuccagaacgucaaccgcaucaccuacggcgccugcccccgguacgugaagcagaacacccucaagcuggcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcucaaccggcugaucgggaagaccaacgagaaguuccaccagaucgagaaggaguucuccgagguggagggccgcauccaggaccuggagaaguacgccgaggacaccaagaucgaccucuggagcuacaacgccgagcugcugguggcccucgagaaccagcacacgaucgaccugaccgacuccgagaugaacaagcuguucgagaagaccaagaagcagcuccgggagaacgcggaggacaugggcaacgggugcuucaagaucuaccacaagugcgacaacgccugcaucggcucgauccgcaacgggaccuacgaccacgacgucuaccgcgacgaggcccugaacaaccgguuccagaucaagggcguggagcugaaguccggguacaaggacuggauccucuggaucagcuucgccaucuccugcuuccugcugugcguggcccuccugggcuucaucaugugggcgugccagaagggcaacauccgcugcaacaucugcaucuga

SEQ ID NO: 9382 - RNA, 1701 nt, Artificial Sequence
  derived and/or modified CDS sequence (AUadapt) from InfluenzaA__AFM72455__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcagcugaaguucaaguaccccgcccugaacgugaccaugcccaacaacgaggaguucgacaagcucuacaucuggggcguccaccaccccgugaccgacaacgaccagaucuuccuguacgcgcaggccucggggcggaucaccguguccacgaagcgcagccagcagaccgucaucccgaacaucggguuccggccccgcgugcggaacaaccccucgcgcaucuccaucuacuggaccaucgugaagcccggcgacauccugcucaucaacagcaccggcaaccugaucgccccgcggggguacuucaagauccgcuccggcaagucguccaucaugcggagcgacgcccccaucgggaagugcaacuccgagugcaucacgcccaacggcucgauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcugaaccggcucaucgggaagaccaacgagaaguuccaccagaucgagaaggaguucuccgagguggagggccgcauccaggaccuggagaaguacgccgaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacaugggcaacgggugcuucaagaucuaccacaagugcgacaacgccugcaucggcucgauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggcgugccagaagggcaacauccgcugcaacaucugcaucuga

SEQ ID NO: 9383 - RNA, 1701 nt, Artificial Sequence
  derived and/or modified CDS sequence (AUadapt) from InfluenzaA__AFM72466__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgugaccgacaaggaccagaucuuccuguacgcgcaggccucggggcggaucaccguguccacgaagcgcagccagcagaccgucaucccgaacaucggguuccggccccgcgugcggaacaaccccucgcgcaucuccaucuacuggaccaucgugaagcccggcgacauccugcucaucaacagcaccggcaaccugaucgccccgcggggguacuucaagauccgcuccggcaagucguccaucaugcggagcgacgcccccaucgggaagugcaacuccgagugcaucacgcccaacggcucgauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcugaaccggcucaucgggaagaccaacgagaaguuccaccagaucgagaaggaguucuccgagguggagggccgcauccaggaccuggagaaguacgccgaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacaugggcaacgggugcuucaagaucuaccacaagugcgacaacgccugcaucggcucgauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggcgugccagaagggcaacauccgcugcaacaucugcaucuga

SEQ ID NO: 9384 - RNA, 1701 nt, Artificial Sequence
  derived and/or modified CDS sequence (AUadapt) from InfluenzaA__AFM72488__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacagcuucuucucccgccugaacuggcucacgcagcugaaguucaaguaccccgcccugaacgugaccaugcccaacaacgagaaguucgacaagcucuacaucuggggcguccaccaccccgugaccgacaacgagcagaucuuccuguacgcgcaggccagcgggcggaucaccguguccacgaagcgcucgcagcagaccgucaucccgaacaucggcuuccggccccgcgugcggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccaagugcaucacgcccaacggcucgauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggucguacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 9385 - RNA, 1701 nt, Artificial Sequence
  derived and/or modified CDS sequence (AUadapt) from InfluenzaA__AFM72499__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcagcugaaguucaaguaccccgcccugaacgugaccaugcccaacaacgagaaguucgacaagcucuacaucuggggcguccaccaccccgugaccgacaacgaccagaucuuccuguacgcgcaggccagcgggcggaucaccguguccacgaagcgcucgcagcagaccgucaucccgaacaucggcagccggccccgcgugcggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 9386 - RNA, 1698 nt, Artificial Sequence
  derived and/or modified CDS sequence (AUadapt) from InfluenzaA__AFM72521__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggcgccucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgggagcagcucuccagcguguccagccuggagcgcuucgagaucuucccgaaggaguccucguggcccaaccacacggucaccgggguguccgccagcugcucccacaacggcgagagcuccuucuaccggaaccugcucuggcugaccgggaagaacggccuguaccccaaccucucgaaguccuacgccaacaacaaggagaaggaggugcugguccuguggggcgugcaccacccgcccaacaucggcaaccagaaggcccucuaccacaccgagaacgccuacgugagcgucgugagcucccacuacucgcgcaaguucacgcccgagaucgccaagcggcccaaggugcgcgaccaggagggccggaucaacuacuacuggacccugcuggagcccggggacaccaucaucuucgaggcgaacggcaaccucaucgccccgcgcuacgccuucgcccugucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcucggccaagcuccggauggucaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcucgagcgccggauggagaaccugaacaagaaggucgacgacggcuucaucgacaucuggaccuacaacgccgagcugcucgugcugcuggagaacgagcgcacgcucgacuuccacgacucgaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacggcgugaagcuggaguccaugggcgucuaccagauccuggccaucuacucgaccguggccagcucccucgugcugcuggucagccucggggccaucuccuucuggaugugcagcaacggcucccugcagugccgcaucugcaucuga

SEQ ID NO: 9387 - RNA, 1698 nt, Artificial Sequence; identical to SEQ ID NO: 9386
  derived and/or modified CDS sequence (AUadapt) from InfluenzaA__AFM72532__HA

SEQ ID NO: 9388 - RNA, 1698 nt, Artificial Sequence; identical to SEQ ID NO: 9386
  derived and/or modified CDS sequence (AUadapt) from InfluenzaA__AFM72543__HA

SEQ ID NO: 9389 - RNA, 1698 nt, Artificial Sequence
  derived and/or modified CDS sequence (AUadapt) from InfluenzaA__AFM72554__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggcgccucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgggagcagcucuccagcguguccagccuggagcgcuucgagaucuucccgaaggaguccucguggcccaaccacacggucaccgggguguccgccagcugcucccacaacggcgagagcuccuucuaccggaaccugcucuggcugaccgggaagaacggccuguaccccaaccucucgaaguccuacgccaacaacaaggagaaggaggugcugguccuguggggcgugcaccacccgcccaacaucggcaaccagaaggcccucuaccacaccgagaacgccuacgugagcgucgugagcucccacuacucgcgcaaguucacgcccgagaucgccaagcggcccaaggugcgcgaccaggagggccggaucaacuacuacuggacccugcuggagcccggggacaccaucaucuucgaggcgaacggcaaccucaucgccccgcgcuacgccuucgcccugucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcucggccaagcuccggauggucaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcucgagcgccggauggagaaccugaacaagaaggucgacgacggcuucaucgacaucuggaccuacaacgccgagcugcucgugcugcuggagaacgagcgcacgcucgacuuccacgacucgaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacgaggugaagcuggaguccaugggcgucuaccagauccuggccaucuacucgaccguggccagcucccucgugcugcuggucagccucggcgccaucuccuucuggaugugcagcaacgggucccugcagugccgcaucugcaucuga

SEQ ID NO: 9390 - RNA, 1701 nt, Artificial Sequence
  derived and/or modified CDS sequence (AUadapt) from InfluenzaA__AFM72565__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcuccugcauccgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccgggcggaucaccgugucgacgaagcgcagccagcagaccgugauccccaacaucggcucccggccccgcguccggaacauccccucgcgcaucuccaucuacuggaccaucgugaagccgggcgacauccugcugaucaacagcaccgggaaccucaucgcgccccggggcuacuucaagauccgcuccgggaaguccuccaucaugcggucggacgcccccaucggcaagugcaacuccgagugcaucacgcccaacggcagcaucccgaacgacaagcccuuccagaacgugaaccgcaucaccuacggggccugcccccgguacgucaagcagaacacccugaagcuggccaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgccugcaucgggucgauccgcaacggcaccuacgaccacgacgucuaccgcgacgaggcgcugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 9391 - RNA, 1701 nt, Artificial Sequence; identical to SEQ ID NO: 184
  derived and/or modified CDS sequence (AUadapt) from InfluenzaA__AFM72576__HA

SEQ ID NO: 9392 - RNA, 1698 nt, Artificial Sequence
  derived and/or modified CDS sequence (AUadapt) from InfluenzaA__AFM72799__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaaggcgccccuccagcuggggaacugcagcgucgccggcuggauccuggggaacccggagugcggccuccugaucuccaaggagagcugguccuacaucguggagcgccccaaccccgagaacgggaccugcuaccccgggcacuucgccgacuacgaggagcugcgggagcagcucucguccgugagcuccuucgagcgcuucgagaucuucccgaaggagagcuccuggcccaaccacacggucaccggcgugucggccuccugcagccacaacggggaguccagcuucuacaagaaccugcuguggcucaccggcaagaacgggcuguaccccaaccuguccaagucguacgccaacaacaaggagaaggaggugcucguccuguggggcgugcaccacccgcccaacaucggcaaccagaugacccuguaccacaaggagaacgccuacguguccgucgugagcagccacuacucccggaaguucacgcccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucgcgcggcuucggcuccgggaucaucaacagcaacgcccccauggacgagugcgacgccaagugccagacgccccagggcgcgaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggcuucaucgagggcggcuggaccgggaugguggacggcugguacggguaccaccaccagaacgagcagggcagcggcuacgccgcggaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacguguggaccuacaacgccgagcugcuggugcuccuggagaacgagcggacgcuggacuuccacgacuccaacgucaagaaccucuacgagaaggugaagaaccagcugaagaacaacgccaaggagaucggcaacgggugcuucgaguucuaccacaagugcaacgacgagugcauggagucggugaagaacggcaccuacgacuaccccaaguacuccgaggagagcaagcugucccgcgagaagaucgacggcgucaagcucgagagcauggggguguaccagauccuggcgaucuacuccaccguggccucgagccugguccuccuggugucccugggcgccaucagcuucuggaugugcuccaacgggagccuccagugccggaucugcaucuga

SEQ ID NO: 9393 - RNA, 1698 nt, Artificial Sequence; identical to SEQ ID NO: 9392
  derived and/or modified CDS sequence (AUadapt) from InfluenzaA__AFM72810__HA

SEQ ID NO: 9394 - RNA, 1698 nt, Artificial Sequence; identical to SEQ ID NO: 9392
  derived and/or modified CDS sequence (AUadapt) from InfluenzaA__AFM72821__HA

SEQ ID NO: 9395 - RNA, 1701 nt, Artificial Sequence; identical to SEQ ID NO: 51
  derived and/or modified CDS sequence (AUadapt) from InfluenzaA__AFM72852__HA

SEQ ID NO: 9396 - RNA, 1701 nt, Artificial Sequence
  derived and/or modified CDS sequence (AUadapt) from InfluenzaA__AFM72862__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaacuccuacaucaacgacaagggcaaggaggugcugguccucugggggauccaccaccccagcaccucggccgaccagcagucccuguaccagaacgccgacgccuacguguucgugggcagcucccgguacucgaagacguucaagccggagaucgccauccgccccaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagucgaccaagcugcgccucgcgaccggccugcggaacauccccuccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 9397 - RNA, 1701 nt, Artificial Sequence
  derived and/or modified CDS sequence (AUadapt) from InfluenzaA__AFM72872__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccucgaccggggagaucugcgacagcccccaccagauccucgacggcaagaacugcacgcugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccucguccggcacccuggaguucaacaacgagagcuucaacuggaccggggugacccagaacggcacguccucggccugcauccgccgguccaagaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuucccguacgcgcaggccucggggcggaucacgguguccaccaagcgcagccagcagaccgccauccccaacaucggcucgcggccccgcgugcggaacauccccucccgcaucucgaucuacuggaccaucgucaagccgggcgacauccugcugaucaacuccacggggaaccucaucgcgccccggggcuacuucaagauccgcagcgggaaguccucgaucaugcgguccgacgcccccaucggcaagugcaacucggagugcaucacccccaacggcuccaucccgaacgacaagcccuuccagaacgugaaccgcaucaccuacggggccugcccccgguacgugaagcagaacacccugaagcuggccacgggcaugcgcaacguccccgagaagcagacccgggggaucuucggcgccaucgccggguucaucgagaacggcugggagggcaugguggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacacgaagaucgaccugugguccuacaacgccgagcugcucguggcccuggagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagucgggcuacaaggacuggauccuguggaucuccuucgccaucagcugcuuccugcucugcguggcccugcugggcuucaucaugugggcgugccagaaggggaacauccggugcaacaucugcaucuga

SEQ ID NO: 9398 - RNA, 1701 nt, Artificial Sequence
  derived and/or modified CDS sequence (AUadapt) from InfluenzaA__AFM72883__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcaagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaagaacuccuucuucucgcgccugaacuggcucacgcaccugaacuucaaguaccccgcccugaacgugaccaugcccaacaacgagcaguucgacaagcucuacaucuggggcguccaccaccccgugaccgacaaggaccagaucuuccuguacgcgcaggccuccgggcggaucaccgugagcacgaagcgcucccagcagaccgucaucccgaacaucgggucgcggccccgcgugcggaacauccccacccgcaucucgaucuacuggaccaucgugaagcccggcgacauccugcucaucaacuccacgggcaaccugaucgccccgcggggguacuucaagaugcagagcggcaaguccucgaucaugcgcuccgacgcccccaucgggaagugcaacagcgagugcaucacccccaacggcuccauccccaacgacaagccguuccagaacgucaaccggaucaccuacggcgccugcccccgcuacgugaagcagaacacccugaagcucgcgacggggaugcggaacgugcccgagaagcagacccgcggcaucuucggggccaucgccggcuucaucgagaacgggugggagggcauggucgacggcugguacggguuccggcaccagaacucggagggccgcgggcaggccgccgaccugaaguccacccaggcggccaucgaccagaucaacggcaagcugaaccggcucaucgggaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggacguacgaccacaacguguaccgcgacgaggcccucaacaaccgguuccagaucaagggcguggagcucaagucgggguacaaggacuggauccuguggaucuccuucgccaucagcugcuuccugcugugcgucgcccugcucggcuucaucaugugggccugccagaagggcaacauccgcugcaacaucugcaucuga

SEQ ID NO: 9399 - RNA, 1701 nt, Artificial Sequence
  derived and/or modified CDS sequence (AUadapt) from InfluenzaA__AFM72894__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcaagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaagaacuccuucuucagccgccugaacuggcucacgcagcugaacuucaaguaccccgcccugaacgugaccaugcccaacaacgagcaguucgacaagcucuacaucuggggcguccaccaccccgugaccgacaaggaccagaucuuccuguacgcgcaggccuccgggcggaucaccgugucgacgaagcgcucccagcagaccgucaucccgaacaucgggucgcggccccgcgugcggaacauccccagccgcaucuccaucuacuggaccaucgugaagcccggcgacauccugcucaucaacucgaccggcaaccugaucgccccgcggggguacuucaagaugcaguccggcaagagcuccaucaugcgcucggacgcccccaucgggaagugcaacuccgagugcaucacgcccaacggcagcauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacgggugggagggcauggucgacggcugguacggguuccggcaccagaacuccgagggccgcgggcaggccgccgaccucaagucgacccaggcggccaucgaccagaucaacggcaagcugaaccggcugaucgggaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgggagaacgccgaggacaugggcaacgggugcuucaagaucuaccacaagugcgacaacgcgugcaucggcucgauccgcaacgggaccuacgaccacaacguguaccgcgacgaggcccucaacaaccgguuccagaucaagggcguggagcugaaguccggguacaaggacuggauccuguggaucagcuucgccaucuccugcuuccuccugugcgucgcccugcucggcuucaucaugugggccugccagaagggcaacauccgcugcaacaucugcaucuga

SEQ ID NO: 9400 - RNA, 1701 nt, Artificial Sequence
  derived and/or modified CDS sequence (AUadapt) from InfluenzaA__AFM72916__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaagaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuucccguacgcgcaggccagcgggcggaucaccguguccacgaagcgcucgcagcagaccgccauccccaacaucggcucgcggccccgcgugcggaacauccccucccgcaucagcaucuacuggaccaucgucaagccgggcgacauccuccugaucaacuccaccgggaaccugaucgcgccccggggcuacuucaagauccgcucggggaaguccagcaucaugcgguccgacgcccccaucggcaagugcaacucgggcugcaucacgcccaacggguccaucccgaacgacaagcccuuccagaacgugaaccgcaucaccuacggcgccugcccccgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacgucgaggacaccaagaucgaccucugguccuacaacgccgagcugcugguggcccucgagaaccagcacacgaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggcuacaaggacugguuccucuggaucuccuucgccaucagcugcuuccugcugugcguggcccuccugggguucaucaugugggcgugccagaagggcaacauccggugcaacaucugcaucuga

SEQ ID NO: 9401 - RNA, 1701 nt, Artificial Sequence
  derived and/or modified CDS sequence (AUadapt) from InfluenzaA__AFM72927__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaccagccuguacgcgcaggccuccgggcggaucacggugucgaccaagcgcucgcagcagaccgugaucccgaacaucggcucccggccccgcguccggaacauccccagccgcaucuccaucuacuggaccaucgugaagcccggcgacauccugcucaucaacucgaucgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9402 - RNA, 1701 nt, Artificial Sequence
  derived and/or modified CDS sequence (AUadapt) from InfluenzaA__AFM72938__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaccucgcuguacgcgcaggccuccgggcggaucacggugagcaccaagcgcucgcagcagaccgugaucccgaacaucggcucccggccccgcguccggaacaaccccucgcgcaucuccaucuacuggaccaucgugaagcccggcgacauccugcucaucaacagcaucgggaaccugaucgccccgcggggcuacuucaagauccgcuccgggaaguccuccaucaugcggucggacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9403 - RNA, 1701 nt, Artificial Sequence
  derived and/or modified CDS sequence (AUadapt) from InfluenzaA__AFM72949__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcagcugaaguucaaguaccccgcccugaacgugaccaugcccaacaacgagcaguucgacaagcucuacaucuggggcguccaccaccccgggaccgacaacgaccagaccucgcuguacgcgcaggccuccgggcggaucacggugagcaccaagcgcucgcagcagaccgugaucccgaacaucggcucccggccccgcguccggaacaaccccucgcgcaucuccaucuacuggaccaucgugaagcccggcgacauccugcucaucaacagcaucgggaaccugaucgccccgcggggcuacuucaagauccgcuccgggaaguccuccaucaugcggucggacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9404 - RNA, 1701 nt, Artificial Sequence
  derived and/or modified CDS sequence (AUadapt) from InfluenzaA__AFM72960__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaaguggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaccagccuguacgcgcaggccuccgggcggaucacggugucgaccaagcgcucgcagcagaccgugaucccgaacaucggcucccggccccgcguccggaacauccccagccgcaucuccaucuacuggaccaucgugaagcccggcgacauccugcucaucaacucgaucgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9405 - RNA, 1701 nt, Artificial Sequence
  derived and/or modified CDS sequence (AUadapt) from InfluenzaA__AFM72971__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaaguggaccggggugacccagaacggcaccuccucggccugcauccgccgguccaacaacucguucuucucccgccugaacuggcucacgcagcugaacuucaaguaccccgcccugaacgugaccaugcccaacaacgagcaguucgacaagcucuacaucuggggcguccaccaccccgggaccgacaacgaccagaccagccuguacgcgcaggccuccgggcggaucacggugucgaccaagcgcucgcagcagaccgugaucccgaacaucggcucccggccccgcguccggaacauccccagccgcaucuccaucuacuggaccaucgugaagcccggcgacauccugcucaucaacucgaucgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9406 - RNA, 1701 nt, Artificial Sequence
  derived and/or modified CDS sequence (AUadapt) from InfluenzaA__AFM72982__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacagcgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccuccgggcggaucaccgugucgacgaagcgcagccagcaggccgugauccccaacaucggcucccggccccgcguccggaacauccccucgcgcaucuccaucuacuggaccaucgugaagccgggcgacauccugcugaucaacagcaccgggaaccucaucgcgccccggggcuacuucaagauccgcuccgggaaguccuccaucaugcggucggacgcccccaucggcaagugcaacuccgagugcaucacccccaacggcucgaucccgaacgacaagcccuuccagaacgugaaccgcaucacguacggggccugcccccgguacaucaagcaguccacccugaagcuggccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccucaaguccacgcaggccgccaucgaccagaucaacgggaagcugaaccgccugaucggcaagaccaacgagaaguuccaccagaucgagaaggaguucucggagguggagggccggauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagucgggcuacaaggacuggauccuguggaucucccuggccaucagcugcuuccuccugugcguggcccugcucggcuucaucaugugggcgugccagaaggggaacauccggugcaacaucugcaucuga

SEQ ID NO: 9407 - RNA, 1701 nt, Artificial Sequence
  derived and/or modified CDS sequence (AUadapt) from InfluenzaA__AFM72993__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucggccggggagaucugcgacagcccccaccagauccucgacggcgagaacugcacccugaucgacgcccugcucggggacccccagugcgacggcuuccagaacaagaagugggaccuguucguggagcgcucgcgggcguacuccaacugcuaccccuacgacgugccggacuacgccagccugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccugcaccccgggaccuacaaggaccagaucuuccuguacgcccaggccagcgggcgcaucaccguguccaccaagcggucgcagcaggccgugaucccgaacaucggcagccgcccccggguccgcaacauccccucccggaucagcaucuacuggacgaucgugaagcccggcgacauccuccugaucaacuccaccgggaaccugaucgccccgcgcggcuacuucaagauccggucggggaaguccagcaucaugcgcuccgacgcgcccaucggcaagugcaacucggagugcaucacccccaacggcuccauccccaacgacaagccguuccagaacgugaaccggaucaccuacggggccugcccccgcuacgucaagcagagcacgcucaagcuggccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggcggccgaccugaaguccacccaggccgccaucgaccagaucaacgggaagcucaaccggcugaucggcaagacgaacgagaaguuccaccagaucgagaaggaguucuccgaggucgagggccgcauccaggaccuggagaaguacguggaggacaccaagaucgaccucuggucguacaacgccgagcugcugguggcgcucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgccugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcguggcgcuccugggcuucaucaugugggccugccagaaggggaacauccgcugcaacaucugcaucuga

SEQ ID NO: 9408 - RNA, 1701 nt, Artificial Sequence
  derived and/or modified CDS sequence (AUadapt) from InfluenzaA__AFM73004__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucggccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccugcaccccgggaccuacaaggaccagaucuuccuguacgcccaggccucggggcgcgugaccguguccaccaagcggagccagcaggccgucaucccgaacaucggcagccgcccccgggugcgcaacauccccucccggaucucgaucuacuggacgaucgugaagcccggcgacauccuccugaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgucaaccggaucaccuacggggccugcccccgcuacgugaagcagagcacgcucaagcuggccaccggcaugcggaacgugcccgagaagcagacccgcgggaucuucggcgccaucgccggguucaucgagaacggcugggagggcauggucgacgggugguacggcuuccggcaccagaacuccgaggggcgcggccaggcggccgaccugaaguccacccaggccgccaucgaccagaucaacgggaagcucaaccggcugaucggcaagacgaacgagaaguuccaccagaucgagaaggaguucuccgagguggagggccgcauccaggaccuggagaaguacguggaggacaccaagaucgaccucuggucguacaacgccgagcugcuggucgcgcucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgccugcaucgggagcauccggaacggcaccuacgaccacgacguguaccgcgacgaggcccugaacaaccgguuccagaucaaggggguggagcugaaguccggcuacaaggacuggauccucuggaucagcuucgccaucuccugcuucuuccugugcgucgcgcugcucggcuucaucaugugggccugccagaaggggaacauccgcugcaacaucugcaucuga

SEQ ID NO: 9409 - RNA, 1701 nt, Artificial Sequence
  derived and/or modified CDS sequence (AUadapt) from InfluenzaA__AFM73015__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccgcgaggggcggaugaacuacuacuggacccugguggagcccggcgacaagaucacguucgaggccaccgggaaccucguggucccccgcuacgcguucgccauggagcggaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcgccucgccaccgggcugcggaacgugccguccauccagagccgcggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcggaucgagaaccugaacaagaaggucgacgacggguuccucgacaucuggaccuacaacgccgagcugcuggugcuccuggagaacgagcgcacgcuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggccaucuacucgaccgucgcguccagccuggugcucguggucucccugggcgccaucucguucuggaugugcagcaacggcucccugcagugccgcaucugcaucuga

SEQ ID NO: 9410 - RNA, 1701 nt, Artificial Sequence
  derived and/or modified CDS sequence (AUadapt) from InfluenzaA__AFM73025__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggacgaccagcagucgcuguaccagaacgccgacaccuacguguucgugggcaccucccgguacagcaagaaguucaagcccgagaucgccauccgcccgaagguccgggaccgcgaggggcggaugaacuacuacuggacccugguggagcccggcgacaagaucacguucgaggccaccgggaaccucguggucccccgcuacgccuucgcgauggagcggaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcgccucgccaccgggcugcggaacgugccguccauccagagccgcggccuguucggggccaucgcgggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgccgugggcaaggaguucaaccaccuggagaagcggaucgagaaccugaacaagaaggucgacgacggguuccucgacaucuggaccuacaacgcggagcugcuggugcuccuggagaacgagcgcacgcuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggccaucuacucgaccgucgccuccagccuggugcucguggucucccugggcgcgaucucguucuggaugugcagcaacggcucccugcagugccgcaucugcaucuga

SEQ ID NO: 9411 - RNA, 1701 nt, Artificial Sequence; identical to SEQ ID NO: 9410
  derived and/or modified CDS sequence (AUadapt) from InfluenzaA__AFM73035__HA

SEQ ID NO: 9412 - RNA, 1701 nt, Artificial Sequence
  derived and/or modified CDS sequence (AUadapt) from InfluenzaA__AFM73045__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgagagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9413 - RNA, 1701 nt, Artificial Sequence
  derived and/or modified CDS sequence (AUadapt) from InfluenzaA__AFM73055__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucguggagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9414 - RNA, 1701 nt, Artificial Sequence
  derived and/or modified CDS sequence (AUadapt) from InfluenzaA__AFM73065__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaaggaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9415 - RNA, 1701 nt, Artificial Sequence; identical to SEQ ID NO: 1160
  derived and/or modified CDS sequence (AUadapt) from InfluenzaA__AFM73477__HA

SEQ ID NO: 9416 - RNA, 1707 nt, Artificial Sequence; identical to SEQ ID NO: 211
  derived and/or modified CDS sequence (AUadapt) from InfluenzaA__AFM78567__HA

SEQ ID NO: 9417 - RNA, 1701 nt, Artificial Sequence
  derived and/or modified CDS sequence (AUadapt) from InfluenzaA__AFM78646__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagggccuguaccagaacgccgacgccuacguguucgugggcacgucccgguacucgaagaaguucaagccggagaucgccauccgccccaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucucggacacgccggugcacgacugcaacacgaccugccagacccccaagggggccaucaacaccucccugcccuuccagaacauccaccccaucaccaucggcaagugcccgaaguacgucaagagcaccaagcugcggcucgcgaccgggcugcgcaacgugcccuccauccagucgcggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgucccuggugcucguggucagccugggcgccaucucguucuggaugugcuccaacggcagccugcagugccggaucugcaucuga

SEQ ID NO: 9418 - RNA, 1698 nt, Artificial Sequence
  derived and/or modified CDS sequence (AUadapt) from InfluenzaA__AFM85179__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacgcuguacuacaccgagaacgccuacgucagcguggugagcucccacuacucgcgccgguucacccccgagaucaccaagcgccccaagguccgggaccaggagggccgcaucaacuacuacuggacgcuccuggagcccggggacaccaucaucuucgaggccaacggcaaccugaucgccccgugguacgcguucgcccucucccggggguucggcagcggcaucaucaucuccaacgcccccauggacgagugcgacgccaagugccagacgccccagggggccaucaacagcucccugcccuuccagaacgugcacccggugaccaucggcgagugccccaaguacguccgcagcgcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucaccaacaaggucaacagcgugaucgagaagaugaacacgcaguucaccgccguggggaaggaguucaacaaguucgagcgccggauggagaaccugaacaagaaggucgacgacggcuuccucgacaucuggaccuacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcugaaccgggagaagaucgacggcgucaagcucgaguccaugggcguguaccagauccuggccaucuacagcaccguggcgagcucccugguccuccuggugagccugggggccaucuccuucuggaugugcagcaacggcucccuccagugccgcaucugcaucuga

SEQ ID NO: 9419 - RNA, 1701 nt, Artificial Sequence
  derived and/or modified CDS sequence (AUadapt) from InfluenzaA__AFN11846__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgagggguucaacuggaccggcguggcccaggacgggaaguccuacgccugcaagcgcggcuccgucaagucguucuucucccggcucaacuggcugcacaagcuggaguacaaguaccccgcgcucaacgugaccaugcccaacaacgacaaguucgacaagcuguacaucuggggcgugcaccaccccagcacggacuccgaccagaccucgcuguacgugcaggccuccgggcgcgucaccgugagcaccaagcggucgcagcagacggugaucccgaacaucggcucccgccccuggguccgggggaucagcucccgcaucucgaucuacuggaccaucgugaagcccggcgacauccuccugaucaacuccaccgggaaccugaucgcgccccggggcuacuucaagauccgcaacggcaagagcuccaucaugcggucggacgccccgaucgggaacugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 9420 - RNA, 1701 nt, Artificial Sequence; identical to SEQ ID NO: 3775
  derived and/or modified CDS sequence (AUadapt) from InfluenzaA__AFN17371__HA

SEQ ID NO: 9421 - RNA, 1701 nt, Artificial Sequence; identical to SEQ ID NO: 116
  derived and/or modified CDS sequence (AUadapt) from InfluenzaA__AFN17381__HA

SEQ ID NO: 9422 - RNA, 1701 nt, Artificial Sequence; identical to SEQ ID NO: 116
  derived and/or modified CDS sequence (AUadapt) from InfluenzaA__AFN17391__HA

SEQ ID NO: 9423 - RNA, 1701 nt, Artificial Sequence; identical to SEQ ID NO: 116
  derived and/or modified CDS sequence (AUadapt) from InfluenzaA__AFN17401__HA

SEQ ID NO: 9424 - RNA, 1701 nt, Artificial Sequence; identical to SEQ ID NO: 116
  derived and/or modified CDS sequence (AUadapt) from InfluenzaA__AFN17411__HA

SEQ ID NO: 9425 - RNA, 1701 nt, Artificial Sequence; identical to SEQ ID NO: 116
  derived and/or modified CDS sequence (AUadapt) from InfluenzaA__AFN17421__HA

SEQ ID NO: 9426 - RNA, 1701 nt, Artificial Sequence; identical to SEQ ID NO: 3005
  derived and/or modified CDS sequence (AUadapt) from InfluenzaA__AFN17431__HA

SEQ ID NO: 9427 - RNA, 1701 nt, Artificial Sequence
  derived and/or modified CDS sequence (AUadapt) from InfluenzaA__AFN17441__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaaggccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9428 - RNA, 1701 nt, Artificial Sequence; identical to SEQ ID NO: 5469
  derived and/or modified CDS sequence (AUadapt) from InfluenzaA__AFN17451__HA

SEQ ID NO: 9429 - RNA, 1701 nt, Artificial Sequence; identical to SEQ ID NO: 3756
  derived and/or modified CDS sequence (AUadapt) from InfluenzaA__AFN17467__HA

SEQ ID NO: 9430 - RNA, 1701 nt, Artificial Sequence; identical to SEQ ID NO: 116
  derived and/or modified CDS sequence (AUadapt) from InfluenzaA__AFN17477__HA

SEQ ID NO: 9431 - RNA, 1701 nt, Artificial Sequence; identical to SEQ ID NO: 3775
  derived and/or modified CDS sequence (AUadapt) from InfluenzaA__AFN17487__HA

SEQ ID NO: 9432 - RNA, 1701 nt, Artificial Sequence; identical to SEQ ID NO: 116
  derived and/or modified CDS sequence (AUadapt) from InfluenzaA__AFN17497__HA

SEQ ID NO: 9433 - RNA, 1701 nt, Artificial Sequence; identical to SEQ ID NO: 116
  derived and/or modified CDS sequence (AUadapt) from InfluenzaA__AFN17507__HA

SEQ ID NO: 9434 - RNA, 1701 nt, Artificial Sequence; identical to SEQ ID NO: 3756
  derived and/or modified CDS sequence (AUadapt) from InfluenzaA__AFN17517__HA

SEQ ID NO: 9435 - RNA, 1701 nt, Artificial Sequence; identical to SEQ ID NO: 3775
  derived and/or modified CDS sequence (AUadapt) from InfluenzaA__AFN17527__HA

SEQ ID NO: 9436 - RNA, 1701 nt, Artificial Sequence; identical to SEQ ID NO: 116
  derived and/or modified CDS sequence (AUadapt) from InfluenzaA__AFN17537__HA

SEQ ID NO: 9437 - RNA, 1701 nt, Artificial Sequence; identical to SEQ ID NO: 3156
  derived and/or modified CDS sequence (AUadapt) from InfluenzaA__AFN17547__HA

SEQ ID NO: 9438 - RNA, 1701 nt, Artificial Sequence; identical to SEQ ID NO: 4445
  derived and/or modified CDS sequence (AUadapt) from InfluenzaA__AFN17557__HA

SEQ ID NO: 9439 - RNA, 1701 nt, Artificial Sequence; identical to SEQ ID NO: 3756
  derived and/or modified CDS sequence (AUadapt) from InfluenzaA__AFN17567__HA

SEQ ID NO: 9440 - RNA, 1701 nt, Artificial Sequence; identical to SEQ ID NO: 3156
  derived and/or modified CDS sequence (AUadapt) from InfluenzaA__AFN17574__HA

SEQ ID NO: 9441 - RNA, 1701 nt, Artificial Sequence; identical to SEQ ID NO: 116
  derived and/or modified CDS sequence (AUadapt) from InfluenzaA__AFN17580__HA

SEQ ID NO: 9442 - RNA, 1701 nt, Artificial Sequence; identical to SEQ ID NO: 116
  derived and/or modified CDS sequence (AUadapt) from InfluenzaA__AFN17586__HA

SEQ ID NO: 9443 - RNA, 1701 nt, Artificial Sequence; identical to SEQ ID NO: 3775
  derived and/or modified CDS sequence (AUadapt) from InfluenzaA__AFN17595__HA

SEQ ID NO: 9444 - RNA, 1701 nt, Artificial Sequence; identical to SEQ ID NO: 116
  derived and/or modified CDS sequence (AUadapt) from InfluenzaA__AFN17605__HA

SEQ ID NO: 9445 - RNA, 1701 nt, Artificial Sequence; identical to SEQ ID NO: 116
  derived and/or modified CDS sequence (AUadapt) from InfluenzaA__AFN17615__HA

SEQ ID NO: 9446 - RNA, 1701 nt, Artificial Sequence; identical to SEQ ID NO: 116
  derived and/or modified CDS sequence (AUadapt) from InfluenzaA__AFN17625__HA

SEQ ID NO: 9447 - RNA, 1701 nt, Artificial Sequence; identical to SEQ ID NO: 116
  derived and/or modified CDS sequence (AUadapt) from InfluenzaA__AFN17635__HA

SEQ ID NO: 9448 - RNA, 1701 nt, Artificial Sequence
  derived and/or modified CDS sequence (AUadapt) from InfluenzaA__AFN17645__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcgucgagaucuuccccaagaccucguccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 9449 - RNA, 1701 nt, Artificial Sequence; identical to SEQ ID NO: 3775
  derived and/or modified CDS sequence (AUadapt) from InfluenzaA__AFN17655__HA

SEQ ID NO: 9450 - RNA, 1701 nt, Artificial Sequence; identical to SEQ ID NO: 3775
  derived and/or modified CDS sequence (AUadapt) from InfluenzaA__AFN17665__HA

SEQ ID NO: 9451 - RNA, 1701 nt, Artificial Sequence
  derived and/or modified CDS sequence (AUadapt) from InfluenzaA__AFN17675__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccgagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 9452 - RNA, 1701 nt, Artificial Sequence
  derived and/or modified CDS sequence (AUadapt) from InfluenzaA__AFN17685__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagccccgggacaagaucaccuucgaggcgaccgggaaccucguggugccccgcuacgccuucgccauggagcggaacgccggcuccgggaucaucaucagcgacacgcccguccacgacugcaacacgaccugccagaccccgaagggcgccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucgggaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgcgaggagaucgacggggugaagcucgagagcacccggaucuaccagauccuggcgaucuacuccaccguggccucgagccugguccucguggugucccugggcgccaucucguucuggaugugcuccaacgggagccugcagugccgcaucugcaucuga

SEQ ID NO: 9453 - RNA, 1701 nt, Artificial Sequence; identical to SEQ ID NO: 116
  derived and/or modified CDS sequence (AUadapt) from InfluenzaA__AFN17695__HA

SEQ ID NO: 9454 - RNA, 1701 nt, Artificial Sequence; identical to SEQ ID NO: 116
  derived and/or modified CDS sequence (AUadapt) from InfluenzaA__AFN17705__HA

SEQ ID NO: 9455 - RNA, 1701 nt, Artificial Sequence; identical to SEQ ID NO: 3543
  derived and/or modified CDS sequence (AUadapt) from InfluenzaA__AFN17715__HA

SEQ ID NO: 9456 - RNA, 1701 nt, Artificial Sequence
  derived and/or modified CDS sequence (AUadapt) from InfluenzaA__AFN17725__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgcagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9457 - RNA, 1701 nt, Artificial Sequence; identical to SEQ ID NO: 116
  derived and/or modified CDS sequence (AUadapt) from InfluenzaA__AFN17735__HA

SEQ ID NO: 9458 - RNA, 1701 nt, Artificial Sequence; identical to SEQ ID NO: 116
  derived and/or modified CDS sequence (AUadapt) from InfluenzaA__AFN17742__HA

SEQ ID NO: 9459 - RNA, 1701 nt, Artificial Sequence; identical to SEQ ID NO: 116
  derived and/or modified CDS sequence (AUadapt) from InfluenzaA__AFN17748__HA

SEQ ID NO: 9460 - RNA, 1701 nt, Artificial Sequence; identical to SEQ ID NO: 116
  derived and/or modified CDS sequence (AUadapt) from InfluenzaA__AFN17757__HA

SEQ ID NO: 9461 - RNA, 1701 nt, Artificial Sequence; identical to SEQ ID NO: 3543
  derived and/or modified CDS sequence (AUadapt) from InfluenzaA__AFN17767__HA

SEQ ID NO: 9462 - RNA, 1701 nt, Artificial Sequence; identical to SEQ ID NO: 7924
  derived and/or modified CDS sequence (AUadapt) from InfluenzaA__AFN17774__HA

SEQ ID NO: 9463 - RNA, 1701 nt, Artificial Sequence; identical to SEQ ID NO: 116
  derived and/or modified CDS sequence (AUadapt) from InfluenzaA__AFN17783__HA

SEQ ID NO: 9464 - RNA, 1701 nt, Artificial Sequence; identical to SEQ ID NO: 3543
  derived and/or modified CDS sequence (AUadapt) from InfluenzaA__AFN17793__HA

SEQ ID NO: 9465 - RNA, 1701 nt, Artificial Sequence; identical to SEQ ID NO: 116
  derived and/or modified CDS sequence (AUadapt) from InfluenzaA__AFN17803__HA

SEQ ID NO: 9466 - RNA, 1701 nt, Artificial Sequence; identical to SEQ ID NO: 116
  derived and/or modified CDS sequence (AUadapt) from InfluenzaA__AFN17813__HA

SEQ ID NO: 9467 - RNA, 1701 nt, Artificial Sequence
  derived and/or modified CDS sequence (AUadapt) from InfluenzaA__AFN17823__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccgagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9468 - RNA, 1701 nt, Artificial Sequence
  derived and/or modified CDS sequence (AUadapt) from InfluenzaA__AFN17833__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgaacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9469 - RNA, 1701 nt, Artificial Sequence; identical to SEQ ID NO: 7423
  derived and/or modified CDS sequence (AUadapt) from InfluenzaA__AFN17843__HA

SEQ ID NO: 9470 - RNA, 1701 nt, Artificial Sequence; identical to SEQ ID NO: 116
  derived and/or modified CDS sequence (AUadapt) from InfluenzaA__AFN17853__HA

SEQ ID NO: 9471 - RNA, 1701 nt, Artificial Sequence; identical to SEQ ID NO: 3156
  derived and/or modified CDS sequence (AUadapt) from InfluenzaA__AFN17863__HA

SEQ ID NO: 9472 - RNA, 1701 nt, Artificial Sequence
  derived and/or modified CDS sequence (AUadapt) from InfluenzaA__AFN17873__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccggcagcugguccuacaucguggagaccucguccagcgacaacggcacgugcuaccccggggacuucaucgacuacgaggagcuccgggagcagcuguccucgguguccagcuucgagcgcuucgagaucuuccccaagaccuccucguggcccaaccacgaccugaacaagggcgucaccgccgccugcccgcacgccggggcgaaguccuucuacaagaaccucaucuggcuggugaagaagggcaacagcuaccccaagcuguccaagucguacaucaacgacaaggggaaggaggugcucguccuguggggcauccaccaccccuccaccagcgccgaccagcagucgcuguaccagaacgccgacgccuacguguucgugggcacgucccgguacucgaagaaguucaagcccgagaucgccauccgcccgaagguccgggaccaggaggggcgcaugaacuacuacuggacccucguggagcccggcgacaagaucaccuucgaggcgaccgggaaccugguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcuccggcuggcgaccgggcugcgcaacgugccguccauccagagccggggccucuucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccuggacaucuggaccuacaacgccgagcugcucgugcugcuggagaacgagcggacccucgacuaccacgacagcaacgugaagaaccuguacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcucaaccgggaggagaucgacggggugaagcuggagagcacccgcaucuaccagauccuggcgaucuacuccaccgucgccucgucccucgugcugguggucagccugggcgccaucucguucuggaugugcuccaacggcagccuccagugccggaucugcaucuga

SEQ ID NO: 9473 - RNA, 1701 nt, Artificial Sequence
  derived and/or modified CDS sequence (AUadapt) from InfluenzaA__AFN17883__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagacccugaagggcgccaucaacaccucccugccguuccagaacauccaccccaucaccaucgggaagugccccaaguacgucaagagcaccaagcuccggcuggcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacucgaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagucgacccgcaucuaccagauccuggcgaucuacuccaccgucgccagcucgcucgugcugguggucucccugggggccaucagcuucuggaugugcuccaacggcagccuccagugccggaucugcaucuga

SEQ ID NO: 9474 - RNA, 1701 nt, Artificial Sequence; identical to SEQ ID NO: 116
  derived and/or modified CDS sequence (AUadapt) from InfluenzaA__AFN17893__HA

SEQ ID NO: 9475 - RNA, 1701 nt, Artificial Sequence
  derived and/or modified CDS sequence (AUadapt) from InfluenzaA__AFN17903__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgagagcaacaagggggucaccgccgccugcccgcacgccggcgcgaaguccuucuacaagaaccugaucuggcucgugaagaaggggaacucguaccccaagcuguccaagagcuacgugaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 9476 - RNA, 1701 nt, Artificial Sequence; identical to SEQ ID NO: 3267
  derived and/or modified CDS sequence (AUadapt) from InfluenzaA__AFN17919__HA

SEQ ID NO: 9477 - RNA, 1701 nt, Artificial Sequence; identical to SEQ ID NO: 3156
  derived and/or modified CDS sequence (AUadapt) from InfluenzaA__AFN17929__HA

SEQ ID NO: 9478 - RNA, 1701 nt, Artificial Sequence; identical to SEQ ID NO: 9172
  derived and/or modified CDS sequence (AUadapt) from InfluenzaA__AFN17939__HA

SEQ ID NO: 9479 - RNA, 1701 nt, Artificial Sequence; identical to SEQ ID NO: 3775
  derived and/or modified CDS sequence (AUadapt) from InfluenzaA__AFN17949__HA

SEQ ID NO: 9480 - RNA, 1701 nt, Artificial Sequence
  derived and/or modified CDS sequence (AUadapt) from InfluenzaA__AFN17959__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacgugaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 9481 - RNA, 1701 nt, Artificial Sequence; identical to SEQ ID NO: 4596
  derived and/or modified CDS sequence (AUadapt) from InfluenzaA__AFN17969__HA

SEQ ID NO: 9482 - RNA, 1701 nt, Artificial Sequence; identical to SEQ ID NO: 3775
  derived and/or modified CDS sequence (AUadapt) from InfluenzaA__AFN17979__HA

SEQ ID NO: 9483 - RNA, 1701 nt, Artificial Sequence
  derived and/or modified CDS sequence (AUadapt) from InfluenzaA__AFN17989__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucggcaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 9484 - RNA, 1701 nt, Artificial Sequence; identical to SEQ ID NO: 116
  derived and/or modified CDS sequence (AUadapt) from InfluenzaA__AFN17999__HA

SEQ ID NO: 9485 - RNA, 1701 nt, Artificial Sequence
  derived and/or modified CDS sequence (AUadapt) from InfluenzaA__AFN18019__HA
augaaggccauccuggugguccuccuguacaccuucgccaccgcgaaggccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9486 - RNA, 1701 nt, Artificial Sequence; identical to SEQ ID NO: 3775
  derived and/or modified CDS sequence (AUadapt) from InfluenzaA__AFN18039__HA

SEQ ID NO: 9487 - RNA, 1701 nt, Artificial Sequence; identical to SEQ ID NO: 116
  derived and/or modified CDS sequence (AUadapt) from InfluenzaA__AFN18049__HA

SEQ ID NO: 9488 - RNA, 1701 nt, Artificial Sequence
  derived and/or modified CDS sequence (AUadapt) from InfluenzaA__AFN18059__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacgccugcauggagucggugaagaacgggaccuacgacuaccccaaguacuccgaggaggcgaagcugaaccgggaggagaucgacggcgugaagcucgagagcacgcgcaucuaccagauccuggccaucuacuccaccgucgccucgagccuggugcucguggucucccugggggccaucucguucuggaugugcuccaacggcagccugcagugccggaucugcaucuga

SEQ ID NO: 9489 - RNA, 1701 nt, Artificial Sequence; identical to SEQ ID NO: 116
  derived and/or modified CDS sequence (AUadapt) from InfluenzaA__AFN18078__HA

SEQ ID NO: 9490 - RNA, 1701 nt, Artificial Sequence
  derived and/or modified CDS sequence (AUadapt) from InfluenzaA__AFN18088__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggugcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 9491 - RNA, 1701 nt, Artificial Sequence
  derived and/or modified CDS sequence (AUadapt) from InfluenzaA__AFN18098__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccagcuccgacaacggcacgugcuaccccggcaacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccgucgagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9492 - RNA, 1701 nt, Artificial Sequence
  derived and/or modified CDS sequence (AUadapt) from InfluenzaA__AFN18105__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacaccaacugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 9493 - RNA, 1701 nt, Artificial Sequence; identical to SEQ ID NO: 3156
  derived and/or modified CDS sequence (AUadapt) from InfluenzaA__AFN18107__HA

SEQ ID NO: 9494 - RNA, 1701 nt, Artificial Sequence; identical to SEQ ID NO: 9488
  derived and/or modified CDS sequence (AUadapt) from InfluenzaA__AFN18117__HA

SEQ ID NO: 9495 - RNA, 1701 nt, Artificial Sequence; identical to SEQ ID NO: 116
  derived and/or modified CDS sequence (AUadapt) from InfluenzaA__AFN18119__HA

SEQ ID NO: 9496 - RNA, 1701 nt, Artificial Sequence
  derived and/or modified CDS sequence (AUadapt) from InfluenzaA__AFN18121__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgcgguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggugcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacucgaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagucgacccggaucuaccagauccuggcgaucuacuccaccguggccagcucgcuggugcucgucgugucccugggggccaucagcuucuggaugugcuccaacggcagccugcagugccgcaucugcaucuga

SEQ ID NO: 9497 - RNA, 1701 nt, Artificial Sequence; identical to SEQ ID NO: 9488
  derived and/or modified CDS sequence (AUadapt) from InfluenzaA__AFN18133__HA

SEQ ID NO: 9498 - RNA, 1701 nt, Artificial Sequence; identical to SEQ ID NO: 9172
  derived and/or modified CDS sequence (AUadapt) from InfluenzaA__AFN18135__HA

SEQ ID NO: 9499 - RNA, 1701 nt, Artificial Sequence; identical to SEQ ID NO: 3756
  derived and/or modified CDS sequence (AUadapt) from InfluenzaA__AFN18137__HA

SEQ ID NO: 9500 - RNA, 1701 nt, Artificial Sequence
  derived and/or modified CDS sequence (AUadapt) from InfluenzaA__AFN18139__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagggccuguaccagaacgccgacgccuacguguucgugggcagcucccgguacucgaagaaguucaagcccgagaucgccauccgcccgaagguccgggaccaggaggggcgcaugaacuacuacuggacgcugguggagcccggcgacaagaucaccuucgaggcgaccgggaaccucguggucccccgguacgccuucgccauggagcgcaacgccggcuccggcaucaucaucagcgacacccccgugcacgacugcaacacgaccugccagaccccgaagggggccaucaacaccucccugcccuuccacaacauccaccccaucacgaucggcaagugccccaaguacgucaagucgaccaagcugcggcucgcgaccgggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 9501 - RNA, 1701 nt, Artificial Sequence; identical to SEQ ID NO: 9496
  derived and/or modified CDS sequence (AUadapt) from InfluenzaA__AFN18141__HA

SEQ ID NO: 9502 - RNA, 1701 nt, Artificial Sequence; identical to SEQ ID NO: 3775
  derived and/or modified CDS sequence (AUadapt) from InfluenzaA__AFN18148__HA

SEQ ID NO: 9503 - RNA, 1701 nt, Artificial Sequence; identical to SEQ ID NO: 4078
  derived and/or modified CDS sequence (AUadapt) from InfluenzaA__AFN18155__HA

SEQ ID NO: 9504 - RNA, 1701 nt, Artificial Sequence
  derived and/or modified CDS sequence (AUadapt) from InfluenzaA__AFN18157__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacgccuucgugggcacgucccgguacagcaagaaguucaagcccgagaucgcgauccgcccgaaggugcgggaccaggaggggcgcaugaacuacuacuggacccuggucgagcccggcgacaagaucaccuucgaggccaccgggaaccucguggugccccgguacgccuucgccauggagcgcaacgccggcuccggcaucaucaucucggacacgcccguccacgacugcaacacgaccugccagaccccgaagggggcgaucaacaccucccugcccuuccagaacauccaccccaucaccaucggcaagugccccaaguacgucaagagcaccaagcugcggcucgccaccgggcugcgcaacgugccguccauccagucgcggggccuguucggggccaucgccggcuucaucgagggcggguggacgggcaugguggacgggugguacggcuaccaccaccagaacgagcagggguccggcuacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggcgaagcugaaccgggaggagaucgacggggugaagcucgagagcacccgcaucuaccagauccuggccaucuacuccaccguggccucgagccugguccucguggugucccugggcgccaucucguucuggaugugcuccaacggcagccugcagugccggaucugcaucuga

SEQ ID NO: 9505 - RNA, 1701 nt, Artificial Sequence
  derived and/or modified CDS sequence (AUadapt) from InfluenzaA__AFN18159__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcuccaagagcuucuacaagaaccugaucuggcucgugaagaaggggaacuccuaccccaagcugucgaagagcuacaucaacgacaagggcaaggaggugcugguccucugggggauccaccaccccuccaccucggcggaccagcagucccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccggguccggcaucaucaucagcgacacccccgugcacgacugcaacacgaccugccagaccccgaagggcgccaucaacaccucccugcccuuccacaacauccaccccaucacgaucgggaagugccccaaguacgucaagucgaccaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacgcagaacgccaucgacgagaucaccaacaaggugaacuccgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 9506 - RNA, 1701 nt, Artificial Sequence
  derived and/or modified CDS sequence (AUadapt) from InfluenzaA__AFN18164__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucaucgugccccgguacgcguucgccauggagcgcaacgccggguccggcaucaucaucucgaacacccccguccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgugaucgagaagaugaacacgcaguucaccgcggucggcaaggagcugaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggccguguacuccaccgucgcgucgagccucgugcugguggucucccugggggccaucucguucuggaugugcuccaacggcagccuccagugccggaucugcaucuga

SEQ ID NO: 9507 - RNA, 1701 nt, Artificial Sequence
  derived and/or modified CDS sequence (AUadapt) from InfluenzaA__AFN18171__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacagcgggaagcucugcaagcugcgcggcgucgcgccccugcaccucgggaagugcaacaucgccggcuggauccuggggaacccggagugcgagucccugucgaccgcguccagcugguccuacaucguggagaccucguccagcgacaacggcaagugcuaccccggcgacuucaucgacuacgaggagcuccgggagcagcuguccucgguguccagcuucgagcgcuucgagaucuuccccaagacguccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcaccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugaaggacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 9508 - RNA, 1701 nt, Artificial Sequence
  derived and/or modified CDS sequence (AUadapt) from InfluenzaA__AFN18176__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccuccuggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgucaagcuggagagcacccgcaucuaccagauccuggcgaucuacuccaccguggccucgagccucgugcuggucgugucccugggggccaucucguucuggaugugcuccaacggcagccuccagugccggaucugcaucuga

SEQ ID NO: 9509 - RNA, 1701 nt, Artificial Sequence
  derived and/or modified CDS sequence (AUadapt) from InfluenzaA__AFN18183__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucauggugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 9510 - RNA, 1701 nt, Artificial Sequence; identical to SEQ ID NO: 4466
  derived and/or modified CDS sequence (AUadapt) from InfluenzaA__AFN18195__HA

SEQ ID NO: 9511 - RNA, 1701 nt, Artificial Sequence; identical to SEQ ID NO: 116
  derived and/or modified CDS sequence (AUadapt) from InfluenzaA__AFN18200__HA

SEQ ID NO: 9512 - RNA, 1701 nt, Artificial Sequence
  derived and/or modified CDS sequence (AUadapt) from InfluenzaA__AFN18207__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagagccugaucuggcucgugaagaaggggaacuccuaccccaagcugucgaagagcuacaucaacgacaagggccgggaggugcugguccucugggggauccaccaccccuccaccucggccgaccagcagucccuguaccagaacgccgacgccuacguguucgugggcacgagccgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgucgauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 9513 - RNA, 1701 nt, Artificial Sequence
  derived and/or modified CDS sequence (AUadapt) from InfluenzaA__AFN18214__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucaacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacucgaccgccgccagcucccuggugcugguggucucgcucggggccaucuccuucuggaugugcagcaacggcucccugcagugccggaucugcaucuga

SEQ ID NO: 9514 - RNA, 1701 nt, Artificial Sequence; identical to SEQ ID NO: 5469
  derived and/or modified CDS sequence (AUadapt) from InfluenzaA__AFN18224__HA

SEQ ID NO: 9515 - RNA, 1701 nt, Artificial Sequence; identical to SEQ ID NO: 4466
  derived and/or modified CDS sequence (AUadapt) from InfluenzaA__AFN18231__HA

SEQ ID NO: 9516 - RNA, 1701 nt, Artificial Sequence
  derived and/or modified CDS sequence (AUadapt) from InfluenzaA__AFN18233__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacucccgcaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaagcucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 9517 - RNA, 1701 nt, Artificial Sequence
  derived and/or modified CDS sequence (AUadapt) from InfluenzaA__AFN18243__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 9518 - RNA, 1701 nt, Artificial Sequence; identical to SEQ ID NO: 9003
  derived and/or modified CDS sequence (AUadapt) from InfluenzaA__AFN18245__HA

SEQ ID NO: 9519 - RNA, 1701 nt, Artificial Sequence; identical to SEQ ID NO: 5469
  derived and/or modified CDS sequence (AUadapt) from InfluenzaA__AFN18255__HA

SEQ ID NO: 9520 - RNA, 1701 nt, Artificial Sequence; identical to SEQ ID NO: 9517
  derived and/or modified CDS sequence (AUadapt) from InfluenzaA__AFN18260__HA

SEQ ID NO: 9521 - RNA, 1701 nt, Artificial Sequence; identical to SEQ ID NO: 9517
  derived and/or modified CDS sequence (AUadapt) from InfluenzaA__AFN18267__HA

SEQ ID NO: 9522 - RNA, 1701 nt, Artificial Sequence
  derived and/or modified CDS sequence (AUadapt) from InfluenzaA__AFN18269__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagaaguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9523 - RNA, 1701 nt, Artificial Sequence; identical to SEQ ID NO: 4078
  derived and/or modified CDS sequence (AUadapt) from InfluenzaA__AFN18271__HA

SEQ ID NO: 9524 - RNA, 1701 nt, Artificial Sequence; identical to SEQ ID NO: 4466
  derived and/or modified CDS sequence (AUadapt) from InfluenzaA__AFN18273__HA

SEQ ID NO: 9525 - RNA, 1701 nt, Artificial Sequence; identical to SEQ ID NO: 4078
  derived and/or modified CDS sequence (AUadapt) from InfluenzaA__AFN18280__HA

SEQ ID NO: 9526 - RNA, 1701 nt, Artificial Sequence; identical to SEQ ID NO: 3712
  derived and/or modified CDS sequence (AUadapt) from InfluenzaA__AFN18303__HA

SEQ ID NO: 9527 - RNA, 1701 nt, Artificial Sequence
  derived and/or modified CDS sequence (AUadapt) from InfluenzaA__AFN18305__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccugggcaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggcgaagcugaaccgggaggagaucgacggggugaagcucgagagcacccgcaucuaccagauccuggccaucuacuccaccguggccucgagccugguccucguggugucccugggcgccaucucguucuggaugugcuccaacggcagccugcagugccggaucugcaucuga

SEQ ID NO: 9528 - RNA, 1701 nt, Artificial Sequence
  derived and/or modified CDS sequence (AUadapt) from InfluenzaA__AFN18307__HA
augaaggccauccuggugguccuccuguacaccuucgccgcggccaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacaccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9529 - RNA, 1701 nt, Artificial Sequence
  derived and/or modified CDS sequence (AUadapt) from InfluenzaA__AFN18312__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaaggggaucaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucgugaucucccugggggccaucucguucuggaugugcuccaacggcagccugcagugccggaucugcaucuga

SEQ ID NO: 9530 - RNA, 1701 nt, Artificial Sequence; identical to SEQ ID NO: 5279
  derived and/or modified CDS sequence (AUadapt) from InfluenzaA__AFN18319__HA

SEQ ID NO: 9531 - RNA, 1701 nt, Artificial Sequence; identical to SEQ ID NO: 7376
  derived and/or modified CDS sequence (AUadapt) from InfluenzaA__AFN18324__HA

SEQ ID NO: 9532 - RNA, 1701 nt, Artificial Sequence; identical to SEQ ID NO: 3267
  derived and/or modified CDS sequence (AUadapt) from InfluenzaA__AFN18334__HA

SEQ ID NO: 9533 - RNA, 1701 nt, Artificial Sequence; identical to SEQ ID NO: 5030
  derived and/or modified CDS sequence (AUadapt) from InfluenzaA__AFN18344__HA

SEQ ID NO: 9534 - RNA, 1701 nt, Artificial Sequence; identical to SEQ ID NO: 116
  derived and/or modified CDS sequence (AUadapt) from InfluenzaA__AFN18354__HA

SEQ ID NO: 9535 - RNA, 1701 nt, Artificial Sequence
  derived and/or modified CDS sequence (AUadapt) from InfluenzaA__AFN18364__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgaccugaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaagaucgacgacggcuuccuggacaucuggaccuacaacgccgagcugcucguccugcuggagaacgagcggacccucgacuaccacgacuccaacgugaagaaccuguacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacucgaccguggccuccagccucguccugguggugucgcugggggccaucuccuucuggaugugcagcaacggcucccuccagugccggaucugcaucuga

SEQ ID NO: 9536 - RNA, 1701 nt, Artificial Sequence; identical to SEQ ID NO: 116
  derived and/or modified CDS sequence (AUadapt) from InfluenzaA__AFN18374__HA

SEQ ID NO: 9537 - RNA, 1701 nt, Artificial Sequence
  derived and/or modified CDS sequence (AUadapt) from InfluenzaA__AFN18381__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccauccggccgaagguccgcgaccaggagggccggaugaacuacuacuggacccuggugaagcccggggacaagaucaccuucgaggcgaccggcaaccucguggucccccgcuacgccuucgccauggagcggaacgccggguccggcaucaucaucagcgacacgcccgugcaggacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9538 - RNA, 1701 nt, Artificial Sequence
  derived and/or modified CDS sequence (AUadapt) from InfluenzaA__AFN18390__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagauccgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 9539 - RNA, 1701 nt, Artificial Sequence
  derived and/or modified CDS sequence (AUadapt) from InfluenzaA__AFN18400__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucaccccgcugcaccucgggaagugcaacaucgccggcuggauccuggggaaccccgagugcgagagccuguccaaggccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgcggccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcaccuccgcggaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgugggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgcgggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggccagcucgcuggugcucgucgugucccugggggcgaucagcuucuggaugugcuccaacggcagccugcagugccggaucugcaucuga

SEQ ID NO: 9540 - RNA, 1701 nt, Artificial Sequence; identical to SEQ ID NO: 3005
  derived and/or modified CDS sequence (AUadapt) from InfluenzaA__AFN18410__HA

SEQ ID NO: 9541 - RNA, 1701 nt, Artificial Sequence; identical to SEQ ID NO: 116
  derived and/or modified CDS sequence (AUadapt) from InfluenzaA__AFN18420__HA

SEQ ID NO: 9542 - RNA, 1701 nt, Artificial Sequence
  derived and/or modified CDS sequence (AUadapt) from InfluenzaA__AFN18430__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 9543 - RNA, 1701 nt, Artificial Sequence; identical to SEQ ID NO: 116
  derived and/or modified CDS sequence (AUadapt) from InfluenzaA__AFN18440__HA

SEQ ID NO: 9544 - RNA, 1701 nt, Artificial Sequence; identical to SEQ ID NO: 116
  derived and/or modified CDS sequence (AUadapt) from InfluenzaA__AFN18450__HA

SEQ ID NO: 9545 - RNA, 1701 nt, Artificial Sequence; identical to SEQ ID NO: 5469
  derived and/or modified CDS sequence (AUadapt) from InfluenzaA__AFN18460__HA

SEQ ID NO: 9546 - RNA, 1701 nt, Artificial Sequence; identical to SEQ ID NO: 3775
  derived and/or modified CDS sequence (AUadapt) from InfluenzaA__AFN18470__HA

SEQ ID NO: 9547 - RNA, 1701 nt, Artificial Sequence; identical to SEQ ID NO: 3005
  derived and/or modified CDS sequence (AUadapt) from InfluenzaA__AFN18480__HA

SEQ ID NO: 9548 - RNA, 1701 nt, Artificial Sequence; identical to SEQ ID NO: 3775
  derived and/or modified CDS sequence (AUadapt) from InfluenzaA__AFN18490__HA

SEQ ID NO: 9549 - RNA, 1701 nt, Artificial Sequence; identical to SEQ ID NO: 116
  derived and/or modified CDS sequence (AUadapt) from InfluenzaA__AFN18497__HA

SEQ ID NO: 9550 - RNA, 1701 nt, Artificial Sequence; identical to SEQ ID NO: 116
  derived and/or modified CDS sequence (AUadapt) from InfluenzaA__AFN18512__HA

SEQ ID NO: 9551 - RNA, 1701 nt, Artificial Sequence
  derived and/or modified CDS sequence (AUadapt) from InfluenzaA__AFN18519__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggagaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 9552 - RNA, 1701 nt, Artificial Sequence
  derived and/or modified CDS sequence (AUadapt) from InfluenzaA__AFN18521__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccggcgaggccaagcugaaccgggaggagaucgacggggucaagcucgagucgacccgcaucuaccagauccuggcgaucuacuccaccguggccagcucgcuggugcucgucgugucccugggcgccaucagcuucuggaugugcuccaacggcagccugcagugccggaucugcaucuga

SEQ ID NO: 9553 - RNA, 1701 nt, Artificial Sequence; identical to SEQ ID NO: 116
  derived and/or modified CDS sequence (AUadapt) from InfluenzaA__AFN18528__HA

SEQ ID NO: 9554 - RNA, 1701 nt, Artificial Sequence; identical to SEQ ID NO: 116
  derived and/or modified CDS sequence (AUadapt) from InfluenzaA__AFN18531__HA

SEQ ID NO: 9555 - RNA, 1701 nt, Artificial Sequence; identical to SEQ ID NO: 5511
  derived and/or modified CDS sequence (AUadapt) from InfluenzaA__AFN18543__HA

SEQ ID NO: 9556 - RNA, 1701 nt, Artificial Sequence; identical to SEQ ID NO: 7796
  derived and/or modified CDS sequence (AUadapt) from InfluenzaA__AFN18545__HA

SEQ ID NO: 9557 - RNA, 1701 nt, Artificial Sequence; identical to SEQ ID NO: 3775
  derived and/or modified CDS sequence (AUadapt) from InfluenzaA__AFN18550__HA

SEQ ID NO: 9558 - RNA, 1701 nt, Artificial Sequence
  derived and/or modified CDS sequence (AUadapt) from InfluenzaA__AFN18557__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 9559 - RNA, 1701 nt, Artificial Sequence
  derived and/or modified CDS sequence (AUadapt) from InfluenzaA__AFN18559__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagaaccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 9560 - RNA, 1701 nt, Artificial Sequence; identical to SEQ ID NO: 3780
  derived and/or modified CDS sequence (AUadapt) from InfluenzaA__AFN18561__HA

SEQ ID NO: 9561 - RNA, 1701 nt, Artificial Sequence; identical to SEQ ID NO: 4016
  derived and/or modified CDS sequence (AUadapt) from InfluenzaA__AFN18563__HA

SEQ ID NO: 9562 - RNA, 1701 nt, Artificial Sequence
  derived and/or modified CDS sequence (AUadapt) from InfluenzaA__AFN18565__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcauggagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 9563 - RNA, 1701 nt, Artificial Sequence
  derived and/or modified CDS sequence (AUadapt) from InfluenzaA__AFN18570__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgugucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 9564 - RNA, 1701 nt, Artificial Sequence; identical to SEQ ID NO: 116
  derived and/or modified CDS sequence (AUadapt) from InfluenzaA__AFN18580__HA

SEQ ID NO: 9565 - RNA, 1701 nt, Artificial Sequence; identical to SEQ ID NO: 3156
  derived and/or modified CDS sequence (AUadapt) from InfluenzaA__AFN18590__HA

SEQ ID NO: 9566 - RNA, 1701 nt, Artificial Sequence
  derived and/or modified CDS sequence (AUadapt) from InfluenzaA__AFN18600__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagaaccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacgccugcauggaguccgugaagaacgggaccuacgacuaccccaaguacagcgaggaggcgaagcugaaccgggaggagaucgacggcgugaagcucgaguccacgcgcaucuaccagauccuggccaucuacucgaccgucgccuccagccuggugcucguggucucgcugggggccaucuccuucuggaugugcagcaacggcucccugcagugccggaucugcaucuga

SEQ ID NO: 9567 - RNA, 1701 nt, Artificial Sequence; identical to SEQ ID NO: 116
  derived and/or modified CDS sequence (AUadapt) from InfluenzaA__AFN18610__HA

SEQ ID NO: 9568 - RNA, 1701 nt, Artificial Sequence
  derived and/or modified CDS sequence (AUadapt) from InfluenzaA__AFN18617__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccaguccgcgaucgacgagaucaccaacaaggucaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaagcgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 9569 - RNA, 1701 nt, Artificial Sequence; identical to SEQ ID NO: 3775
  derived and/or modified CDS sequence (AUadapt) from InfluenzaA__AFN18622__HA

SEQ ID NO: 9570 - RNA, 1701 nt, Artificial Sequence; identical to SEQ ID NO: 116
  derived and/or modified CDS sequence (AUadapt) from InfluenzaA__AFN18629__HA

SEQ ID NO: 9571 - RNA, 1701 nt, Artificial Sequence; identical to SEQ ID NO: 3156
  derived and/or modified CDS sequence (AUadapt) from InfluenzaA__AFN18634__HA

SEQ ID NO: 9572 - RNA, 1701 nt, Artificial Sequence
  derived and/or modified CDS sequence (AUadapt) from InfluenzaA__AFN18644__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccaguccgcgaucgacgagaucaccaacaaggucaacucggugaucgagaaggucaacacccaguucacggccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 9573 - RNA, 1701 nt, Artificial Sequence; identical to SEQ ID NO: 3775
  derived and/or modified CDS sequence (AUadapt) from InfluenzaA__AFN18654__HA

SEQ ID NO: 9574 - RNA, 1701 nt, Artificial Sequence; identical to SEQ ID NO: 116
  derived and/or modified CDS sequence (AUadapt) from InfluenzaA__AFN18664__HA

SEQ ID NO: 9575 - RNA, 1701 nt, Artificial Sequence; identical to SEQ ID NO: 3156
  derived and/or modified CDS sequence (AUadapt) from InfluenzaA__AFN18674__HA

SEQ ID NO: 9576 - RNA, 1701 nt, Artificial Sequence; identical to SEQ ID NO: 116
  derived and/or modified CDS sequence (AUadapt) from InfluenzaA__AFN18684__HA

SEQ ID NO: 9577 - RNA, 1701 nt, Artificial Sequence; identical to SEQ ID NO: 3775
  derived and/or modified CDS sequence (AUadapt) from InfluenzaA__AFN18694__HA

SEQ ID NO: 9578 - RNA, 1701 nt, Artificial Sequence
  derived and/or modified CDS sequence (AUadapt) from InfluenzaA__AFN18704__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccaguccgcgaucgacgagaucaccaacaaggucaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 9579 - RNA, 1701 nt, Artificial Sequence; identical to SEQ ID NO: 5148
  derived and/or modified CDS sequence (AUadapt) from InfluenzaA__AFN18714__HA

SEQ ID NO: 9580 - RNA, 1701 nt, Artificial Sequence; identical to SEQ ID NO: 116
  derived and/or modified CDS sequence (AUadapt) from InfluenzaA__AFN18721__HA

SEQ ID NO: 9581 - RNA, 1701 nt, Artificial Sequence; identical to SEQ ID NO: 5580
  derived and/or modified CDS sequence (AUadapt) from InfluenzaA__AFN18725__HA

SEQ ID NO: 9582 - RNA, 1701 nt, Artificial Sequence
  derived and/or modified CDS sequence (AUadapt) from InfluenzaA__AFN18735__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagacccugaucuggcucgugaagaaggggaacucguaccccaagcuguccaagagcuacaucaacgacaagggcaaggaggugcugguccucugggggauccaccaccccucgacguccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9583 - RNA, 1701 nt, Artificial Sequence; identical to SEQ ID NO: 116
  derived and/or modified CDS sequence (AUadapt) from InfluenzaA__AFN18742__HA

SEQ ID NO: 9584 - RNA, 1701 nt, Artificial Sequence; identical to SEQ ID NO: 4016
  derived and/or modified CDS sequence (AUadapt) from InfluenzaA__AFN18747__HA

SEQ ID NO: 9585 - RNA, 1701 nt, Artificial Sequence
  derived and/or modified CDS sequence (AUadapt) from InfluenzaA__AFN18757__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucgccgugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 9586 - RNA, 1701 nt, Artificial Sequence; identical to SEQ ID NO: 116
  derived and/or modified CDS sequence (AUadapt) from InfluenzaA__AFN18767__HA

SEQ ID NO: 9587 - RNA, 1701 nt, Artificial Sequence; identical to SEQ ID NO: 9578
  derived and/or modified CDS sequence (AUadapt) from InfluenzaA__AFN18774__HA

SEQ ID NO: 9588 - RNA, 1701 nt, Artificial Sequence; identical to SEQ ID NO: 116
  derived and/or modified CDS sequence (AUadapt) from InfluenzaA__AFN18776__HA

SEQ ID NO: 9589 - RNA, 1701 nt, Artificial Sequence; identical to SEQ ID NO: 3780
  derived and/or modified CDS sequence (AUadapt) from InfluenzaA__AFN18778__HA

SEQ ID NO: 9590 - RNA, 1701 nt, Artificial Sequence; identical to SEQ ID NO: 116
  derived and/or modified CDS sequence (AUadapt) from InfluenzaA__AFN18784__HA

SEQ ID NO: 9591 - RNA, 1701 nt, Artificial Sequence; identical to SEQ ID NO: 3780
  derived and/or modified CDS sequence (AUadapt) from InfluenzaA__AFN18789__HA

SEQ ID NO: 9592 - RNA, 1701 nt, Artificial Sequence; identical to SEQ ID NO: 116
  derived and/or modified CDS sequence (AUadapt) from InfluenzaA__AFN18799__HA

SEQ ID NO: 9593 - RNA, 1701 nt, Artificial Sequence; identical to SEQ ID NO: 116
  derived and/or modified CDS sequence (AUadapt) from InfluenzaA__AFN18809__HA

SEQ ID NO: 9594 - RNA, 1701 nt, Artificial Sequence; identical to SEQ ID NO: 4016
  derived and/or modified CDS sequence (AUadapt) from InfluenzaA__AFN18816__HA

SEQ ID NO: 9595 - RNA, 1701 nt, Artificial Sequence; identical to SEQ ID NO: 116
  derived and/or modified CDS sequence (AUadapt) from InfluenzaA__AFN18818__HA

SEQ ID NO: 9596 - RNA, 1701 nt, Artificial Sequence
  derived and/or modified CDS sequence (AUadapt) from InfluenzaA__AFN18820__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaacugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9597 - RNA, 1701 nt, Artificial Sequence; identical to SEQ ID NO: 116
  derived and/or modified CDS sequence (AUadapt) from InfluenzaA__AFN18822__HA

SEQ ID NO: 9598 - RNA, 1701 nt, Artificial Sequence
  derived and/or modified CDS sequence (AUadapt) from InfluenzaA__AFN18824__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugcgccucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9599 - RNA, 1701 nt, Artificial Sequence; identical to SEQ ID NO: 9522
  derived and/or modified CDS sequence (AUadapt) from InfluenzaA__AFN18826__HA

SEQ ID NO: 9600 - RNA, 1701 nt, Artificial Sequence
  derived and/or modified CDS sequence (AUadapt) from InfluenzaA__AFN18828__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaucaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 9601 - RNA, 1701 nt, Artificial Sequence; identical to SEQ ID NO: 9585
  derived and/or modified CDS sequence (AUadapt) from InfluenzaA__AFN18830__HA

SEQ ID NO: 9602 - RNA, 1701 nt, Artificial Sequence; identical to SEQ ID NO: 116
  derived and/or modified CDS sequence (AUadapt) from InfluenzaA__AFN18832__HA

SEQ ID NO: 9603 - RNA, 1701 nt, Artificial Sequence; identical to SEQ ID NO: 3780
  derived and/or modified CDS sequence (AUadapt) from InfluenzaA__AFN18834__HA

SEQ ID NO: 9604 - RNA, 1701 nt, Artificial Sequence
  derived and/or modified CDS sequence (AUadapt) from InfluenzaA__AFN18849__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacguggacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 9605 - RNA, 1701 nt, Artificial Sequence
  derived and/or modified CDS sequence (AUadapt) from InfluenzaA__AFN18856__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9606 - RNA, 1701 nt, Artificial Sequence; identical to SEQ ID NO: 3775
  derived and/or modified CDS sequence (AUadapt) from InfluenzaA__AFN18858__HA

SEQ ID NO: 9607 - RNA, 1701 nt, Artificial Sequence
  derived and/or modified CDS sequence (AUadapt) from InfluenzaA__AFN18860__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcucccacgccggcgccaagagcuucuacaagaaccugaucuggcucgugaagaaggggaacuccuacccgaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgccccaagguccgggaccaggagggccgcauggacuacuacuggacccugguggagccgggggacaagaucaccuucgaggcgaccggcaaccucguggucccccgguacgccuucgccauggagcgcaacgccgggucgggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 9608 - RNA, 1701 nt, Artificial Sequence
  derived and/or modified CDS sequence (AUadapt) from InfluenzaA__AFN18865__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacguccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 9609 - RNA, 1701 nt, Artificial Sequence
  derived and/or modified CDS sequence (AUadapt) from InfluenzaA__AFN18875__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgcccagcagucgcuguaccagaacgccgacgccuacguguucgugggcuccagccgguacuccaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccgggucgggcaucaucaucuccgacacccccgugcacgacugcaacacgaccugccagaccccgaagggcgcgaucaacaccagccugcccuuccacaacauccaccccaucacgaucgggaagugccccaaguacgugaaguccaccaagcugcggcucgccaccggccugcgcaacgucccgucgauccagucccgggggcuguucggcgccaucgccggguucaucgagggcggcuggaccgggaugguggacggcugguacggguaccaccaccagaacgagcagggcagcggguacgccgcggaccucaaguccacgcagaacgccaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggcgaagcugaaccgggaggagaucgacggcgugaagcucgaguccacccgcaucuaccagauccuggccaucuacagcaccgucgccucgucccuggugcucguggucagccugggggccaucuccuucuggaugugcagcaacggcucccugcagugccggaucugcaucuga

SEQ ID NO: 9610 - RNA, 1701 nt, Artificial Sequence
  derived and/or modified CDS sequence (AUadapt) from InfluenzaA__AFN18885__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccaaccugcccuuccagaacauccaccccaucaccaucgggaagugccccaaguacgugaaguccaccaagcugcggcucgcgaccggccugcgcaacgugccgucgacgcagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacgagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugcaagaucugcaucuga

SEQ ID NO: 9611 - RNA, 1701 nt, Artificial Sequence; identical to SEQ ID NO: 116
  derived and/or modified CDS sequence (AUadapt) from InfluenzaA__AFN18892__HA

SEQ ID NO: 9612 - RNA, 1701 nt, Artificial Sequence; identical to SEQ ID NO: 3156
  derived and/or modified CDS sequence (AUadapt) from InfluenzaA__AFN18894__HA

SEQ ID NO: 9613 - RNA, 1701 nt, Artificial Sequence; identical to SEQ ID NO: 9578
  derived and/or modified CDS sequence (AUadapt) from InfluenzaA__AFN18903__HA

SEQ ID NO: 9614 - RNA, 1701 nt, Artificial Sequence; identical to SEQ ID NO: 4016
  derived and/or modified CDS sequence (AUadapt) from InfluenzaA__AFN18910__HA

SEQ ID NO: 9615 - RNA, 1701 nt, Artificial Sequence
  derived and/or modified CDS sequence (AUadapt) from InfluenzaA__AFN18912__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacaccucggugcacgacugcaacacgaccugccagacccccaagggcgccaucaacaccucccugccguuccacaacauccaccccaucacgaucgggaagugccccaaguacgucaagagcaccaagcugcggcucgcgaccggccugcgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 9616 - RNA, 1701 nt, Artificial Sequence; identical to SEQ ID NO: 4016
  derived and/or modified CDS sequence (AUadapt) from InfluenzaA__AFN18917__HA

SEQ ID NO: 9617 - RNA, 1701 nt, Artificial Sequence; identical to SEQ ID NO: 116
  derived and/or modified CDS sequence (AUadapt) from InfluenzaA__AFN18927__HA

SEQ ID NO: 9618 - RNA, 1701 nt, Artificial Sequence; identical to SEQ ID NO: 5580
  derived and/or modified CDS sequence (AUadapt) from InfluenzaA__AFN18937__HA

SEQ ID NO: 9619 - RNA, 1701 nt, Artificial Sequence
  derived and/or modified CDS sequence (AUadapt) from InfluenzaA__AFN18952__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaaccgcaagcugugcaagcuccgcggggucgcgccccugcaccugggcaagugcaacaucgccggguggauccucggcaacccggagugcgagucgcuguccaccgccagcuccuggucguacaucguggagaccuccagcuccgacaacgggacgugcuaccccggcgacuucaucgacuacgaggagcugcgggagcagcucucguccgugagcuccuucgagcgguucgagaucuuccccaagaccucguccuggcccaaccacgacagcaacaagggcgucaccgccgccugcccgcacgccggggcgaaguccuucuacaagaaccugaucuggcuggugaagaagggcaacucguaccccaagcucuccaagagcuacaucaacgacaaggggaaggaggugcugguccuguggggcauccaccaccccucgaccuccgccgaccagcagagccucuaccagaacgccgacgccuacguguucguggggacgucccgcuacucgaagaaguucaagcccgagaucgccauccggccgaagguccgcgaccaggagggccggaugaacuacuacuggacccugguggagcccggcgacaagaucaccuucgaggcgaccgggaaccugguggucccccgcuacgccuucgccauggagcggaacgccggcuccgggaucaucaucagcgacacgcccgugcacgacugcaacacgaccugccagaccccgaagggcgccaucaacaccucccuccccuuccagaacauccaccccaucaccaucggcaagugccccaaguacgucaagucgaccaagcugcgccuggcgaccgggcuccggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgcgagaagaucgacggggugaagcuggagagcacccggaucuaccagauccucgcgaucuacuccaccgucgccucgagccuggugcugguggucucccucggcgccaucucguucuggaugugcuccaacgggagccugcagugccgcaucugcaucuga

SEQ ID NO: 9620 - RNA, 1701 nt, Artificial Sequence
  derived and/or modified CDS sequence (AUadapt) from InfluenzaA__AFN18957__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaaccacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9621 - RNA, 1701 nt, Artificial Sequence; identical to SEQ ID NO: 9003
  derived and/or modified CDS sequence (AUadapt) from InfluenzaA__AFN18964__HA

SEQ ID NO: 9622 - RNA, 1701 nt, Artificial Sequence
  derived and/or modified CDS sequence (AUadapt) from InfluenzaA__AFN18974__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccaugagcuccuucgagcgcuucgagaucuuccccaagaccucguccuggcccaaccacgacccgaacaagggggugaccgccgccugcccccacgccggcgccaagagcuucuacaagaaccugaucuggcucgucaagaaggggaacuccuaccccaagcugucgaaguccuacaucaacgacaagggcaagaaggugcuggugcucugggggauccaccaccccagcaccucggccgaccagcagucccuguaccagaacgccgacgccuacgucuucgugggcacgucgcgguacuccaagaaguucaagccggagaucgccauccgccccaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgacgaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 9623 - RNA, 1701 nt, Artificial Sequence; identical to SEQ ID NO: 4466
  derived and/or modified CDS sequence (AUadapt) from InfluenzaA__AFN18979__HA

SEQ ID NO: 9624 - RNA, 1701 nt, Artificial Sequence
  derived and/or modified CDS sequence (AUadapt) from InfluenzaA__AFN18982__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgaacagcuggcccaaccacgacuccaacaagggcgucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagcacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucaacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 9625 - RNA, 1701 nt, Artificial Sequence; identical to SEQ ID NO: 9517
  derived and/or modified CDS sequence (AUadapt) from InfluenzaA__AFN18984__HA

SEQ ID NO: 9626 - RNA, 1701 nt, Artificial Sequence; identical to SEQ ID NO: 116
  derived and/or modified CDS sequence (AUadapt) from InfluenzaA__AFN18986__HA

SEQ ID NO: 9627 - RNA, 1701 nt, Artificial Sequence; identical to SEQ ID NO: 116
  derived and/or modified CDS sequence (AUadapt) from InfluenzaA__AFN18988__HA

SEQ ID NO: 9628 - RNA, 1701 nt, Artificial Sequence; identical to SEQ ID NO: 4078
  derived and/or modified CDS sequence (AUadapt) from InfluenzaA__AFN18993__HA

SEQ ID NO: 9629 - RNA, 1701 nt, Artificial Sequence; identical to SEQ ID NO: 4078
  derived and/or modified CDS sequence (AUadapt) from InfluenzaA__AFN18999__HA

SEQ ID NO: 9630 - RNA, 1701 nt, Artificial Sequence; identical to SEQ ID NO: 3712
  derived and/or modified CDS sequence (AUadapt) from InfluenzaA__AFN19006__HA

SEQ ID NO: 9631 - RNA, 1701 nt, Artificial Sequence; identical to SEQ ID NO: 116
  derived and/or modified CDS sequence (AUadapt) from InfluenzaA__AFN19026__HA

SEQ ID NO: 9632 - RNA, 1701 nt, Artificial Sequence; identical to SEQ ID NO: 4054
  derived and/or modified CDS sequence (AUadapt) from InfluenzaA__AFN19036__HA

SEQ ID NO: 9633 - RNA, 1701 nt, Artificial Sequence; identical to SEQ ID NO: 116
  derived and/or modified CDS sequence (AUadapt) from InfluenzaA__AFN19043__HA

SEQ ID NO: 9634 - RNA, 1701 nt, Artificial Sequence; identical to SEQ ID NO: 116
  derived and/or modified CDS sequence (AUadapt) from InfluenzaA__AFN19053__HA

SEQ ID NO: 9635 - RNA, 1701 nt, Artificial Sequence; identical to SEQ ID NO: 116
  derived and/or modified CDS sequence (AUadapt) from InfluenzaA__AFN19063__HA

SEQ ID NO: 9636 - RNA, 1701 nt, Artificial Sequence; identical to SEQ ID NO: 116
  derived and/or modified CDS sequence (AUadapt) from InfluenzaA__AFN19070__HA

SEQ ID NO: 9637 - RNA, 1701 nt, Artificial Sequence
  derived and/or modified CDS sequence (AUadapt) from InfluenzaA__AFN19076__HA
augaaggccauccuggugguccuccuguacaccuucgccaccgcgaacgccgacacgcugugcaucggcuaccacgccaacaacucgaccgacaccguggacaccgugcucgagaaggacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9638 - RNA, 1701 nt, Artificial Sequence; identical to SEQ ID NO: 116
  derived and/or modified CDS sequence (AUadapt) from InfluenzaA__AFN19082__HA

SEQ ID NO: 9639 - RNA, 1701 nt, Artificial Sequence; identical to SEQ ID NO: 116
  derived and/or modified CDS sequence (AUadapt) from InfluenzaA__AFN19088__HA

SEQ ID NO: 9640 - RNA, 1701 nt, Artificial Sequence; identical to SEQ ID NO: 116
  derived and/or modified CDS sequence (AUadapt) from InfluenzaA__AFN19097__HA

SEQ ID NO: 9641 - RNA, 1701 nt, Artificial Sequence; identical to SEQ ID NO: 116
  derived and/or modified CDS sequence (AUadapt) from InfluenzaA__AFN19104__HA

SEQ ID NO: 9642 - RNA, 1701 nt, Artificial Sequence; identical to SEQ ID NO: 116
  derived and/or modified CDS sequence (AUadapt) from InfluenzaA__AFN19113__HA

SEQ ID NO: 9643 - RNA, 1701 nt, Artificial Sequence; identical to SEQ ID NO: 116
  derived and/or modified CDS sequence (AUadapt) from InfluenzaA__AFN19119__HA

SEQ ID NO: 9644 - RNA, 1701 nt, Artificial Sequence; identical to SEQ ID NO: 5425
  derived and/or modified CDS sequence (AUadapt) from InfluenzaA__AFN19125__HA

SEQ ID NO: 9645 - RNA, 1701 nt, Artificial Sequence; identical to SEQ ID NO: 116
  derived and/or modified CDS sequence (AUadapt) from InfluenzaA__AFN19134__HA

SEQ ID NO: 9646 - RNA, 1701 nt, Artificial Sequence; identical to SEQ ID NO: 116
  derived and/or modified CDS sequence (AUadapt) from InfluenzaA__AFN19144__HA

SEQ ID NO: 9647 - RNA, 1701 nt, Artificial Sequence; identical to SEQ ID NO: 5469
  derived and/or modified CDS sequence (AUadapt) from InfluenzaA__AFN19154__HA

SEQ ID NO: 9648 - RNA, 1701 nt, Artificial Sequence; identical to SEQ ID NO: 116
  derived and/or modified CDS sequence (AUadapt) from InfluenzaA__AFN19164__HA

SEQ ID NO: 9649 - RNA, 1701 nt, Artificial Sequence; identical to SEQ ID NO: 116
  derived and/or modified CDS sequence (AUadapt) from InfluenzaA__AFN19174__HA

SEQ ID NO: 9650 - RNA, 1701 nt, Artificial Sequence; identical to SEQ ID NO: 116
  derived and/or modified CDS sequence (AUadapt) from InfluenzaA__AFN19184__HA

SEQ ID NO: 9651 - RNA, 1701 nt, Artificial Sequence; identical to SEQ ID NO: 116
  derived and/or modified CDS sequence (AUadapt) from InfluenzaA__AFN19194__HA

SEQ ID NO: 9652 - RNA, 1701 nt, Artificial Sequence; identical to SEQ ID NO: 116
  derived and/or modified CDS sequence (AUadapt) from InfluenzaA__AFN19203__HA

SEQ ID NO: 9653 - RNA, 1701 nt, Artificial Sequence; identical to SEQ ID NO: 116
  derived and/or modified CDS sequence (AUadapt) from InfluenzaA__AFN19213__HA

SEQ ID NO: 9654 - RNA, 1701 nt, Artificial Sequence; identical to SEQ ID NO: 116
  derived and/or modified CDS sequence (AUadapt) from InfluenzaA__AFN19223__HA

SEQ ID NO: 9655 - RNA, 1701 nt, Artificial Sequence; identical to SEQ ID NO: 116
  derived and/or modified CDS sequence (AUadapt) from InfluenzaA__AFN19233__HA

SEQ ID NO: 9656 - RNA, 1701 nt, Artificial Sequence
  derived and/or modified CDS sequence (AUadapt) from InfluenzaA__AFN19243__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcaggacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9657 - RNA, 1701 nt, Artificial Sequence; identical to SEQ ID NO: 5030
  derived and/or modified CDS sequence (AUadapt) from InfluenzaA__AFN19250__HA

SEQ ID NO: 9658 - RNA, 1701 nt, Artificial Sequence; identical to SEQ ID NO: 116
  derived and/or modified CDS sequence (AUadapt) from InfluenzaA__AFN19259__HA

SEQ ID NO: 9659 - RNA, 1701 nt, Artificial Sequence; identical to SEQ ID NO: 116
  derived and/or modified CDS sequence (AUadapt) from InfluenzaA__AFN19269__HA

SEQ ID NO: 9660 - RNA, 1701 nt, Artificial Sequence; identical to SEQ ID NO: 116
  derived and/or modified CDS sequence (AUadapt) from InfluenzaA__AFN19279__HA

SEQ ID NO: 9661 - RNA, 1701 nt, Artificial Sequence; identical to SEQ ID NO: 3775
  derived and/or modified CDS sequence (AUadapt) from InfluenzaA__AFN19286__HA

SEQ ID NO: 9662 - RNA, 1701 nt, Artificial Sequence; identical to SEQ ID NO: 116
  derived and/or modified CDS sequence (AUadapt) from InfluenzaA__AFN19295__HA

SEQ ID NO: 9663 - RNA, 1701 nt, Artificial Sequence; identical to SEQ ID NO: 116
  derived and/or modified CDS sequence (AUadapt) from InfluenzaA__AFN19305__HA

SEQ ID NO: 9664 - RNA, 1701 nt, Artificial Sequence; identical to SEQ ID NO: 3780
  derived and/or modified CDS sequence (AUadapt) from InfluenzaA__AFN19315__HA

SEQ ID NO: 9665 - RNA, 1701 nt, Artificial Sequence; identical to SEQ ID NO: 116
  derived and/or modified CDS sequence (AUadapt) from InfluenzaA__AFN19325__HA

SEQ ID NO: 9666 - RNA, 1701 nt, Artificial Sequence; identical to SEQ ID NO: 116
  derived and/or modified CDS sequence (AUadapt) from InfluenzaA__AFN19335__HA

SEQ ID NO: 9667 - RNA, 1701 nt, Artificial Sequence; identical to SEQ ID NO: 116
  derived and/or modified CDS sequence (AUadapt) from InfluenzaA__AFN19344__HA

SEQ ID NO: 9668 - RNA, 1701 nt, Artificial Sequence
  derived and/or modified CDS sequence (AUadapt) from InfluenzaA__AFN19351__HA
augaagaccaucaucgcccugucguacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggaccggggugacgcagaacggcaccagcuccgccugcauccgccggucgaacaacuccuucuucagccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccucggggcggaucaccguguccaccaagcgcagccagcaggccgugaucccgaacaucggcucgcggccccgcauccggaacauccccucccgcaucagcaucuacuggaccaucgucaagcccggcgacauccugcucaucaacuccacggggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucaccuacggggccugcccccgguacgugaagcagucgacccugaagcucgcgacgggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacgugcggugcaacaucugcaucuga

SEQ ID NO: 9669 - RNA, 1701 nt, Artificial Sequence; identical to SEQ ID NO: 9319
  derived and/or modified CDS sequence (AUadapt) from InfluenzaA__AFN19355__HA

SEQ ID NO: 9670 - RNA, 1701 nt, Artificial Sequence; identical to SEQ ID NO: 9319
  derived and/or modified CDS sequence (AUadapt) from InfluenzaA__AFN19357__HA

SEQ ID NO: 9671 - RNA, 1701 nt, Artificial Sequence; identical to SEQ ID NO: 9319
  derived and/or modified CDS sequence (AUadapt) from InfluenzaA__AFN19361__HA

SEQ ID NO: 9672 - RNA, 1701 nt, Artificial Sequence
  derived and/or modified CDS sequence (AUadapt) from InfluenzaA__AFN19363__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggagcaacuccucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcggaucaccgugagcacgaagcgcucgcagcaggccgugaucccgaacaucggcucccggccccgcauccggaacauccccagccgcaucuccaucuacuggaccaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucacguacggggccugcccccgguacgugaagcaguccacccugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 9673 - RNA, 1701 nt, Artificial Sequence; identical to SEQ ID NO: 7227
  derived and/or modified CDS sequence (AUadapt) from InfluenzaA__AFN19365__HA

SEQ ID NO: 9674 - RNA, 1701 nt, Artificial Sequence
  derived and/or modified CDS sequence (AUadapt) from InfluenzaA__AFN19367__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacggggugaacugcacccugaucgacgcccugcucggcgacccccagugcgacggguuccagaacaagaagugggaccuguucguggagcgcucgaaggccuacuccaacugcuaccccuacgacgucccggacuacgcgagccugcggucccucguggccucguccggcacgcuggaguucaacaacgagagcuucaacuggaccggcgugacccagaacgggaccuccagcgccugcauccgccgguccaacucguccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccucgggccggaucaccgugagcacgaagcgcucccagcaggccgucaucccgaacaucgggucgcggccccgcauccggaacauccccucccgcaucagcaucuacuggaccaucgugaagcccggcgacauccugcucaucaacuccaccggcaaccugaucgccccgcggggguacuucaagauccagagcggcaaguccucgaucaugcgcuccgacgcccccaucgggaagugcaacagcgagugcaucacccccaacggcuccauccccaacgacaagccguuccagaacgugaaccggaucacguacggcgccugcccccgcuacgucaagcagucgacccugaagcucgcgaccgggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccugaaguccacgcaggcggccaucgaccagaucaacggcaagcugaaccggcucaucgggaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacaugggcaacgggugcuucaagaucuaccacaagugcgacaacgcgugcaucggcucgauccgcaacgggaccuacaaccacgacgucuaccgcgacgaggcccucaacaaccgguuccagaucaagggcguggagcugaaguccggguacaaggacuggauccuguggaucagcuucgccaucagcugcuuccuccugugcguggcccugcucggcuucaucaugugggccugccagaagggcaacauccgcugcaacaucugcaucuga

SEQ ID NO: 9675 - RNA, 1701 nt, Artificial Sequence
  derived and/or modified CDS sequence (AUadapt) from InfluenzaA__AFN19369__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacggggugaacugcacccugaucgacgcccugcucggcgacccccagugcgacggguuccagaacaagaagugggaccuguucguggagcgcucgaaggccuacuccaacugcuaccccuacgacgucccggacuacgcgagccugcggucccucguggccucguccggcacgcuggaguucaacaacgagagcuucaacuggaccggcgugacccagaacgggaccuccagcgccugcauccgccgguccaacucguccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccucgggccggaucaccgugagcacgaagcgcucccagcaggccgucaucccgaacaucgggucgcggccccgcauccggaacauccccucccgcaucagcaucuacuggaccaucgugaagcccggcgacauccugcucaucaacuccaccggcaaccugaucgccccgcggggguacuucaagauccgcagcggcaaguccucgaucaugcgguccgacgcccccaucgggaagugcaacagcgagugcaucacccccaacggcuccauccccaacgacaagccguuccagaacgugaaccgcaucacguacggcgccugcccccgguacgucaagcagucgacccugaagcucgcgaccgggaugcgcaacgugcccgagaagcagacccggggcaucuucggggccaucgccggcuucaucgagaacgggugggagggcaugguggacggcugguacggguuccgccaccagaacuccgagggccgggggcaggccgccgaccugaaguccacgcaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgcgugcaucggcucgauccgcaacgggaccuacaaccacgacgucuaccgggacgaggcccucaacaaccgcuuccagaucaagggcguggagcugaaguccggguacaaggacuggauccuguggaucagcuucgccaucagcugcuuccuccugugcguggcccugcucggcuucaucaugugggccugccagaagggcaacauccggugcaacaucugcaucuga

SEQ ID NO: 9676 - RNA, 1701 nt, Artificial Sequence
  derived and/or modified CDS sequence (AUadapt) from InfluenzaA__AFN19373__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgccggagcaacaacuccuucuucucgcgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccguguccaccaagcgcucgcagcaggccgugaucccgaacaucggcagccggccccgcauccggaacauccccucccgcaucucgaucuacuggacgaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucaccuacggggccugcccccgguacgugaagcagucgacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9677 - RNA, 1701 nt, Artificial Sequence; identical to SEQ ID NO: 9319
  derived and/or modified CDS sequence (AUadapt) from InfluenzaA__AFN19375__HA

SEQ ID NO: 9678 - RNA, 1701 nt, Artificial Sequence
  derived and/or modified CDS sequence (AUadapt) from InfluenzaA__AFN19377__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacggggugaacugcacccugaucgacgcccugcucggcgacccccagugcgacggguuccagaacaagaagugggaccuguucguggagcgcucgaaggccuacuccaacugcuaccccuacgacgucccggacuacgcgagccugcggucccucguggccucguccggcacgcuggaguucaacaacgagagcuucaacuggaccggcgugacccagaacgggaccuccagcgccugcauccgccgguccaacucguccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccucgggccggaucaccgugagcacgaagcgcucccagcaggccgucaucccgaacaucgggucgcggccccgcauccggaacauccccucccgcaucagcaucuacuggaccaucgugaagcccggcgacauccugcucaucaacuccaccggcaaccugaucgccccgcggggguacuucaagauccgcagcggcaaguccucgaucaugcgguccgacgcccccaucgggaagugcaacagcgagugcaucacccccaacggcuccauccccaacgacaagccguuccagaacgugaaccgcaucacguacggcgccugcccccgguacgucaagcagucgacccugaagcucgcgaccgggaugcgcaacgugcccgagaagcagacccggggcaucuucggggccaucgccggcuucaucgagaacgggugggagggcaugguggacggcugguacggguuccgccaccagaacuccgagggccgggggcaggccgccgaccugaaguccacgcaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgcgugcaucggcucgauccgcaacgggaccuacaaccacgacgucuaccgggacgaggcccucaacaaccgcuuccagaucaagggcguggagcugaaguccggguacaaggacuggauccuguggaucagcuucgccaucagcugcuuccuccugugcguggcccugcucggcuucaucaugugggccugccagaacggcaacauccggugcaacaucugcaucuga

SEQ ID NO: 9679 - RNA, 1701 nt, Artificial Sequence; identical to SEQ ID NO: 9319
  derived and/or modified CDS sequence (AUadapt) from InfluenzaA__AFN19379__HA

SEQ ID NO: 9680 - RNA, 1701 nt, Artificial Sequence; identical to SEQ ID NO: 9676
  derived and/or modified CDS sequence (AUadapt) from InfluenzaA__AFN19381__HA

SEQ ID NO: 9681 - RNA, 1701 nt, Artificial Sequence; identical to SEQ ID NO: 9675
  derived and/or modified CDS sequence (AUadapt) from InfluenzaA__AFN19383__HA

SEQ ID NO: 9682 - RNA, 1701 nt, Artificial Sequence
  derived and/or modified CDS sequence (AUadapt) from InfluenzaA__AFN19385__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacggggugaacugcacccugaucgacgcccugcucggcgacccccagugcgacggguuccagaacaagaagugggaccuguucguggagcgcuccaaggccuacuccaacugcuaccccuacgacgucccggacuacgcgucgcugcggucccucguggccagcuccggcacgcuggaguucaacaacgagucguucaacuggaccggcgugacccagaacgggaccuccagcgccugcauccgccgguccaacagcuccuucuucucgcgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcggccggaucaccgugucgacgaagcgcucccagcaggccgucaucccgaacaucgggagccggccccgcauccggaacauccccucccgcaucucgaucuacuggaccaucgugaagcccggcgacauccugcucaucaacuccaccggcaaccugaucgccccgcggggguacuucaagauccagagcggcaaguccagcaucaugcgcuccgacgcccccaucgggaagugcaacucggagugcaucacccccaacggcuccauccccaacgacaagccguuccagaacgugaaccggaucacguacggcgccugcccccgcuacgucaagcagagcacccugaagcucgcgaccgggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagucgacgcaggcggccaucgaccagaucaacggcaagcugaaccggcucaucgggaagaccaacgagaaguuccaccagaucgagaaggaguucuccgaggucgagggccgcauccaggaccuggagaaguacguggaggacaccaagaucgacaucuggagcuacaacgccgagcugcucguggcccuggagaaccagcacaccaucgaccugacggacuccgagaugaacaagcuguucgagaagaccaagaagcagcugcgggagaacgccgaggacaugggcaacgggugcuucaagaucuaccacaagugcgacaacgcgugcaucggcucgauccgcaacgggaccuacaaccacgacgucuaccgcgacgaggcccugaacaaccgguuccagaucaagggcguggagcucaaguccggguacaaggacuggauccuguggaucagcuucgccaucagcugcuuccugcucugcguggcccugcugggcuucaucaugugggccugccagaagggcaacauccgcugcaacaucugcaucuga

SEQ ID NO: 9683 - RNA, 1701 nt, Artificial Sequence; identical to SEQ ID NO: 9675
  derived and/or modified CDS sequence (AUadapt) from InfluenzaA__AFN19387__HA

SEQ ID NO: 9684 - RNA, 1701 nt, Artificial Sequence; identical to SEQ ID NO: 9319
  derived and/or modified CDS sequence (AUadapt) from InfluenzaA__AFN19389__HA

SEQ ID NO: 9685 - RNA, 1701 nt, Artificial Sequence; identical to SEQ ID NO: 9319
  derived and/or modified CDS sequence (AUadapt) from InfluenzaA__AFN19391__HA

SEQ ID NO: 9686 - RNA, 1701 nt, Artificial Sequence
  derived and/or modified CDS sequence (AUadapt) from InfluenzaA__AFN19393__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucggccggggagaucugcgacagcccccaccacauccucgacggcgagaacugcacccugaucgacgcccugcucggggacccccagugcgacggcuuccagaacaagaagugggaccuguucguggagcgcucgcgggcguacuccaacugcuaccccuacgacgugccggacuacgccagccugcgcucccucgucgccucguccggcacccuggaguucaacaacgagagcuucaacuggacgggggugacccagaacggcaccuccucggccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccucggggcgcaucaccguguccaccaagcggagccagcaggccgugaucccgaacaucggcucgcgcccccggguccgcaacauccccucccggaucagcaucuacuggacgaucgugaagcccggcgacauccugcucaucaacuccaccgggaaccugaucgccccgcgcggcuacuucaagauccggucggggaaguccagcaucaugcgcuccgacgcgcccaucggcaagugcaacucggagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggucguacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccucuccaaccgguuccagaucaagggggucgagcucaagucgggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 9687 - RNA, 1701 nt, Artificial Sequence; identical to SEQ ID NO: 9675
  derived and/or modified CDS sequence (AUadapt) from InfluenzaA__AFN19397__HA

SEQ ID NO: 9688 - RNA, 1701 nt, Artificial Sequence; identical to SEQ ID NO: 9319
  derived and/or modified CDS sequence (AUadapt) from InfluenzaA__AFN19399__HA

SEQ ID NO: 9689 - RNA, 1701 nt, Artificial Sequence; identical to SEQ ID NO: 9675
  derived and/or modified CDS sequence (AUadapt) from InfluenzaA__AFN19401__HA

SEQ ID NO: 9690 - RNA, 1701 nt, Artificial Sequence; identical to SEQ ID NO: 9319
  derived and/or modified CDS sequence (AUadapt) from InfluenzaA__AFN19403__HA

SEQ ID NO: 9691 - RNA, 1701 nt, Artificial Sequence; identical to SEQ ID NO: 9675
  derived and/or modified CDS sequence (AUadapt) from InfluenzaA__AFN19405__HA

SEQ ID NO: 9692 - RNA, 1701 nt, Artificial Sequence
  derived and/or modified CDS sequence (AUadapt) from InfluenzaA__AFN19407__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggucgggggugacgcagaacggcaccuccagcgccugcaugcgccgguccaacagcuccuucuucucgcgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccagcgggcggaucaccgugucgaccaagcgcucccagcaggccgugaucccgaacaucggcagccggccccgcauccggaacauccccucccgcaucucgaucuacuggaccaucgucaagcccggcgacauccugcucaucaacuccacggggaaccugaucgccccgcggggcuacuucaagauccgcagcgggaaguccagcaucaugcgguccgacgcccccaucggcaagugcaacucggagugcaucacccccaacggcuccauccccaacgacaagccguuccagaacgugaaccgcaucaccuacggggccugcccccgguacgugaagcagagcacccugaagcucgcgacgggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgagguggagggccggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcacguacgaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 9693 - RNA, 1701 nt, Artificial Sequence
  derived and/or modified CDS sequence (AUadapt) from InfluenzaA__AFN19409__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaucggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggacgggggugacccagaacggcaccuccagcgccugcauccgccgguccaacucguccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccucggggcggaucaccgugagcaccaagcgcucccagcaggccgugaucccgaacaucggcucgcggccccgcauccggaacauccccucccgcaucagcaucuacuggacgaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucaccuacggggccugcccccgguacgugaagcagucgacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 9694 - RNA, 1701 nt, Artificial Sequence; identical to SEQ ID NO: 9675
  derived and/or modified CDS sequence (AUadapt) from InfluenzaA__AFN19411__HA

SEQ ID NO: 9695 - RNA, 1701 nt, Artificial Sequence; identical to SEQ ID NO: 9319
  derived and/or modified CDS sequence (AUadapt) from InfluenzaA__AFN19413__HA

SEQ ID NO: 9696 - RNA, 1701 nt, Artificial Sequence
  derived and/or modified CDS sequence (AUadapt) from InfluenzaA__AFN19415__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucggugaugcgguccgacgcccccaucggcaagugcaacagcgagugcaucacccccaacggcuccauccccaacgacaagccguuccagaacgugaaccgcaucacguacggggccugcccccgguacgucaagcagucgacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 9697 - RNA, 1701 nt, Artificial Sequence
  derived and/or modified CDS sequence (AUadapt) from InfluenzaA__AFN19417__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucaucgccucguccggcacgcuggaguucaacaacgagagcuucaacuggaccggggucacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaguccagcgggcggaucaccgucucgacgaagcgcucccagcaggccgugaucccgaacaucggcagccggccccgcauccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgucaaccgcaucacguacggggccugcccccgguacgugaagcagucgacccugaagcucgcgaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 9698 - RNA, 1701 nt, Artificial Sequence
  derived and/or modified CDS sequence (AUadapt) from InfluenzaA__AFN19423__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 9699 - RNA, 1701 nt, Artificial Sequence; identical to SEQ ID NO: 9675
  derived and/or modified CDS sequence (AUadapt) from InfluenzaA__AFN19425__HA

SEQ ID NO: 9700 - RNA, 1701 nt, Artificial Sequence
  derived and/or modified CDS sequence (AUadapt) from InfluenzaA__AFN19437__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccagcuccgccugcauccgccggucgaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcggaucaccgugagcaccaagcgcagccagcaggccgugaucccgaacaucggcucccggccccgcauccggaacauccccucgcgcaucuccaucuacuggacgaucgucaagcccggcgacauccugcucaucaacagcaccgggaaccugaucgccccgcggggcuacuuccgcauccgguccggcaagucguccaucaugcgcagcgacgcccccaucgggaagugcaacuccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaaccggaagcugaaccgccucaucgggaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgggagaacgccgaggacaugggcaacgggugcuucaagaucuaccacaagugcgacaacgcgugcaucggcuccauccgcaacgggaccuacgaccacuacguguaccgggacgaggcccucaacaaccgcuuccagaucaagggcgucgagcucaagagcggguacaaggacuggauccuguggaucuccuucgccaucagcugcuuccugcugugcguggcccugcucggcuucaucaugugggccugccagaagggcaacauccggugcaacaucugcaucuga

SEQ ID NO: 9701 - RNA, 1701 nt, Artificial Sequence
  derived and/or modified CDS sequence (AUadapt) from InfluenzaA__AFN19439__HA
augaagaccaucaucgcccugucgcacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacgggaucaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggcgugacccagaacgggaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagccguccggccggaucaccgugagcacgaagcgcucgcagcaggccgugauccccaacaucgggucccggccccgcauccggaacauccccagccgcaucuccaucuacuggaccaucgucaagccgggcgacauccugcucaucaacucgaccggcaaccugaucgcgccccggggguacuucaagauccgcuccggcaagagcuccaucaugcggucggacgcccccaucgggaagugcaacuccgagugcaucacccccaacggcagcaucccgaacgacaagcccuuccagaacgugaaccgcaucacguacggcgccugcccccgguacgugaagcaguccacccugaagcucgccaccgggaugcgcaacguccccgagaagcagacccggggcaucuucggggccaucgccggcuucaucgagaacgggugggagggcaugguggacggcugguacggguuccgccaccagaacucggagggccgggggcaggccgccgaccugaaguccacgcaggcggccaucgaccagaucaacggcaagcugaaccgccucaucgggaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacaugggcaacgggugcuucaagaucuaccacaagugcgacaacgcgugcaucggcuccauccgcaacgggaccuacaaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 9702 - RNA, 1701 nt, Artificial Sequence; identical to SEQ ID NO: 9676
  derived and/or modified CDS sequence (AUadapt) from InfluenzaA__AFN19443__HA

SEQ ID NO: 9703 - RNA, 1701 nt, Artificial Sequence
  derived and/or modified CDS sequence (AUadapt) from InfluenzaA__AFN19445__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugcggcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9704 - RNA, 1701 nt, Artificial Sequence; identical to SEQ ID NO: 9698
  derived and/or modified CDS sequence (AUadapt) from InfluenzaA__AFN19447__HA

SEQ ID NO: 9705 - RNA, 1701 nt, Artificial Sequence
  derived and/or modified CDS sequence (AUadapt) from InfluenzaA__AFN19451__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgccggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaacggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 9706 - RNA, 1701 nt, Artificial Sequence
  derived and/or modified CDS sequence (AUadapt) from InfluenzaA__AFN19453__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgccggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccaggucaaggggguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 9707 - RNA, 1701 nt, Artificial Sequence; identical to SEQ ID NO: 9698
  derived and/or modified CDS sequence (AUadapt) from InfluenzaA__AFN19455__HA

SEQ ID NO: 9708 - RNA, 1701 nt, Artificial Sequence; identical to SEQ ID NO: 9319
  derived and/or modified CDS sequence (AUadapt) from InfluenzaA__AFN19457__HA

SEQ ID NO: 9709 - RNA, 1701 nt, Artificial Sequence; identical to SEQ ID NO: 9319
  derived and/or modified CDS sequence (AUadapt) from InfluenzaA__AFN19459__HA

SEQ ID NO: 9710 - RNA, 1701 nt, Artificial Sequence; identical to SEQ ID NO: 9676
  derived and/or modified CDS sequence (AUadapt) from InfluenzaA__AFN19461__HA

SEQ ID NO: 9711 - RNA, 1701 nt, Artificial Sequence
  derived and/or modified CDS sequence (AUadapt) from InfluenzaA__AFN19465__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaucgggaacggcugcuucaagaucuaccacaagugcgacaacgcgugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcaucgcccugcucggcuucaucaugugggccugccagaaggggaacauccggugcaacaucugcaucuga

SEQ ID NO: 9712 - RNA, 1701 nt, Artificial Sequence; identical to SEQ ID NO: 9698
  derived and/or modified CDS sequence (AUadapt) from InfluenzaA__AFN19467__HA

SEQ ID NO: 9713 - RNA, 1701 nt, Artificial Sequence; identical to SEQ ID NO: 9706
  derived and/or modified CDS sequence (AUadapt) from InfluenzaA__AFN19469__HA

SEQ ID NO: 9714 - RNA, 1701 nt, Artificial Sequence; identical to SEQ ID NO: 9319
  derived and/or modified CDS sequence (AUadapt) from InfluenzaA__AFN19471__HA

SEQ ID NO: 9715 - RNA, 1701 nt, Artificial Sequence
  derived and/or modified CDS sequence (AUadapt) from InfluenzaA__AFN19473__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcggcagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcggccggaucaccgugucgacgaagcgcucccagcaggccgugaucccgaacaucggcagccggccccgcauccggaacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacccccaacggguccauccccaacgacaagccguuccagaacgugaaccgcaucacguacggcgccugcccccgguacgugaagcagucgacccugaagcucgcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccugaaguccacgcaggcggccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgcgugcaucggcucgauccgcaacgggaccuacaaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 9716 - RNA, 1701 nt, Artificial Sequence; identical to SEQ ID NO: 9698
  derived and/or modified CDS sequence (AUadapt) from InfluenzaA__AFN19475__HA

SEQ ID NO: 9717 - RNA, 1701 nt, Artificial Sequence; identical to SEQ ID NO: 9319
  derived and/or modified CDS sequence (AUadapt) from InfluenzaA__AFN19477__HA

SEQ ID NO: 9718 - RNA, 1701 nt, Artificial Sequence
  derived and/or modified CDS sequence (AUadapt) from InfluenzaA__AFN19479__HA
augaagaccaucaucgcccugucgugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgccggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 9719 - RNA, 1701 nt, Artificial Sequence; identical to SEQ ID NO: 9698
  derived and/or modified CDS sequence (AUadapt) from InfluenzaA__AFN19483__HA

SEQ ID NO: 9720 - RNA, 1701 nt, Artificial Sequence; identical to SEQ ID NO: 7100
  derived and/or modified CDS sequence (AUadapt) from InfluenzaA__AFN19485__HA

SEQ ID NO: 9721 - RNA, 1701 nt, Artificial Sequence; identical to SEQ ID NO: 9319
  derived and/or modified CDS sequence (AUadapt) from InfluenzaA__AFN19487__HA

SEQ ID NO: 9722 - RNA, 1701 nt, Artificial Sequence
  derived and/or modified CDS sequence (AUadapt) from InfluenzaA__AFN19491__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccagcgccugcauccgccgguccaacucguccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccucggggcggaucaccgugagcacgaagcgcucccagcaggccgugaucccgaacaucggcucgcggccccgcauccggaacauccccucccgcaucagcaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggugcugcucggcuucaucaugugggccugccagaaggggaacauccggugcaacaucugcaucuga

SEQ ID NO: 9723 - RNA, 1701 nt, Artificial Sequence
  derived and/or modified CDS sequence (AUadapt) from InfluenzaA__AFN19493__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggccugcaucacgcccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 9724 - RNA, 1701 nt, Artificial Sequence
  derived and/or modified CDS sequence (AUadapt) from InfluenzaA__AFN19495__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcgccggggagaucugcgacucgccccaccacauccuggacggcgagaacugcacccucaucgacgcccugcugggggacccccagugcgacggcuuccagaacaagaagugggaccucuucguggagcgcucccgggcguacuccaacugcuaccccuacgacgugccggacuacgccagccugcgcucccuggucgccucguccggcacccucgaguucaacaacgagagcuucaacuggacgggggugacccagaacggcaccuccucggccugcauccggcgcuccaacaacucguucuucucccggcugaacuggcugacccaccucaacuucaaguaccccgcgcugaacgugacgaugcccaacaacgagcaguucgacaagcuguacaucuggggcguccaccaccccgggaccgacaaggaccagaucuuccucuacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcugaucaacuccaccgggaaccucaucgccccgcgcggcuacuucaagauccggagcgggaaguccucgaucaugcgcuccgacgcgcccaucggcaagugcaacucggagugcaucacccccaacggcuccauccccaacgacaagccguuccagaacgugaaccggaucaccuacggggccugcccccgcuacgucaagcagagcacgcugaagcuggccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccucaagucgacccaggccgccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcgcuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgccugcaucgggucgauccggaacggcaccuacgaccacgacguguaccgcgacgaggcccugaacaaccgguuccagaucaagggggucgagcucaaguccggcuacaaggacuggauccuguggaucagcuucgccaccuccugcuuccugcucugcguggcgcugcugggcuucaucaugugggccugccagaaggggaacauccgcugcaacaucugcaucuga

SEQ ID NO: 9725 - RNA, 1701 nt, Artificial Sequence
  derived and/or modified CDS sequence (AUadapt) from InfluenzaA__AFN19497__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgagaucugcaacucgccccaccagauccucgacggggagaacugcacccugaucgacgcccugcucggcgacccccagugcgacggguuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggcgugacccagaacgggaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcucgcagcaggccgugaucccgaacaucgggucgcggccccgcguccggaacauccccucccgcgugagcaucuacuggaccaucgugaagcccggcgacauccugcucaucaacuccaccggcaaccugaucgccccgcggggguacuucaagauccgcucgggcaaguccagcaucaugcgguccgacgcccccaucgggaagugcaacucgacgugcaucacccccaacggcuccauccccaacgacaagccguuccagaacgucaaccgcaucaccuacggcgcgugcccccgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacucggagggccgggggcaggccgcggaccugaaguccacccaggccgccaucgaccagaucaacggcaagcugaaccgccucaucgggaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggguacaaggacuggauccuguggaucuccuucgccaucagcugcuuccuccugugcgucgcccugcucggcuucaucaugugggcgugccagaagggcaacauccggugcaacaucugcaucuga

SEQ ID NO: 9726 - RNA, 1701 nt, Artificial Sequence; identical to SEQ ID NO: 9676
  derived and/or modified CDS sequence (AUadapt) from InfluenzaA__AFN19499__HA

SEQ ID NO: 9727 - RNA, 1701 nt, Artificial Sequence; identical to SEQ ID NO: 9675
  derived and/or modified CDS sequence (AUadapt) from InfluenzaA__AFN19501__HA

SEQ ID NO: 9728 - RNA, 1701 nt, Artificial Sequence; identical to SEQ ID NO: 7227
  derived and/or modified CDS sequence (AUadapt) from InfluenzaA__AFN19503__HA

SEQ ID NO: 9729 - RNA, 1701 nt, Artificial Sequence; identical to SEQ ID NO: 9676
  derived and/or modified CDS sequence (AUadapt) from InfluenzaA__AFN19507__HA

SEQ ID NO: 9730 - RNA, 1701 nt, Artificial Sequence; identical to SEQ ID NO: 9675
  derived and/or modified CDS sequence (AUadapt) from InfluenzaA__AFN19509__HA

SEQ ID NO: 9731 - RNA, 1701 nt, Artificial Sequence; identical to SEQ ID NO: 9676
  derived and/or modified CDS sequence (AUadapt) from InfluenzaA__AFN19513__HA

SEQ ID NO: 9732 - RNA, 1701 nt, Artificial Sequence; identical to SEQ ID NO: 9675
  derived and/or modified CDS sequence (AUadapt) from InfluenzaA__AFN19515__HA

SEQ ID NO: 9733 - RNA, 1701 nt, Artificial Sequence; identical to SEQ ID NO: 9676
  derived and/or modified CDS sequence (AUadapt) from InfluenzaA__AFN19517__HA

SEQ ID NO: 9734 - RNA, 1701 nt, Artificial Sequence; identical to SEQ ID NO: 9676
  derived and/or modified CDS sequence (AUadapt) from InfluenzaA__AFN19519__HA

SEQ ID NO: 9735 - RNA, 1701 nt, Artificial Sequence; identical to SEQ ID NO: 9319
  derived and/or modified CDS sequence (AUadapt) from InfluenzaA__AFN19521__HA

SEQ ID NO: 9736 - RNA, 1701 nt, Artificial Sequence; identical to SEQ ID NO: 9675
  derived and/or modified CDS sequence (AUadapt) from InfluenzaA__AFN19523__HA

SEQ ID NO: 9737 - RNA, 1701 nt, Artificial Sequence
  derived and/or modified CDS sequence (AUadapt) from InfluenzaA__AFN19527__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggagcaacuccucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcggaucaccgugucgacgaagcgcagccagcaggccgugaucccgaacaucggcucccggccccgcauccggaacauccccucgcgcaucuccaucuacuggaccaucgucaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggccugcccccgguacgugaagcaguccacccugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 9738 - RNA, 1701 nt, Artificial Sequence
  derived and/or modified CDS sequence (AUadapt) from InfluenzaA__AFN19529__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgccggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 9739 - RNA, 1701 nt, Artificial Sequence; identical to SEQ ID NO: 9319
  derived and/or modified CDS sequence (AUadapt) from InfluenzaA__AFN19531__HA

SEQ ID NO: 9740 - RNA, 1701 nt, Artificial Sequence; identical to SEQ ID NO: 9738
  derived and/or modified CDS sequence (AUadapt) from InfluenzaA__AFN19533__HA

SEQ ID NO: 9741 - RNA, 1701 nt, Artificial Sequence
  derived and/or modified CDS sequence (AUadapt) from InfluenzaA__AFN19535__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccaacucguccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaguccucggggcggaucaccgugagcacgaagcgcucccagcaggccgugaucccgaacaucggcucgcggccccgcauccggaacauccccucccgcaucagcaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucacguacggggccugcccccgguacgugaagcagagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacaaccacgacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 9742 - RNA, 1701 nt, Artificial Sequence; identical to SEQ ID NO: 9319
  derived and/or modified CDS sequence (AUadapt) from InfluenzaA__AFN19537__HA

SEQ ID NO: 9743 - RNA, 1701 nt, Artificial Sequence; identical to SEQ ID NO: 9319
  derived and/or modified CDS sequence (AUadapt) from InfluenzaA__AFN19539__HA

SEQ ID NO: 9744 - RNA, 1701 nt, Artificial Sequence; identical to SEQ ID NO: 9319
  derived and/or modified CDS sequence (AUadapt) from InfluenzaA__AFN19543__HA

SEQ ID NO: 9745 - RNA, 1701 nt, Artificial Sequence
  derived and/or modified CDS sequence (AUadapt) from InfluenzaA__AFN19545__HA
augaagaccaucaucgcccugucguacauccucugccugguguucgcccagaagcugcccggcuccgacaacagcaccgcgacgcucugccuggggcaccacgccgucccgaacggcaccaucgugaagaccaucaccaacgaccgcaucgaggugacgaacgccaccgagcugguccagaacuccucgaucggggagaucugcgacagcccccaccagauccucgacggcgagaacugcacccugaucgacgcccugcucggggacccccagugcgacggcuucaagaacaagaagugggaccuguucguggagcggucgaaggccuacuccaacugcuaccccuacgacgugccggacuacgcgagccugcgcucccucgucgccucguccggcacccuggaguucaacaacgagagcuucaacuggacgggggugacccagaacggcaccuccucggccugcauccggcgcuccaacaacagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccaguccgggaaguccuccaucaugcggucggacgcccccaucggcaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 9746 - RNA, 1701 nt, Artificial Sequence; identical to SEQ ID NO: 9319
  derived and/or modified CDS sequence (AUadapt) from InfluenzaA__AFN19547__HA

SEQ ID NO: 9747 - RNA, 1701 nt, Artificial Sequence
  derived and/or modified CDS sequence (AUadapt) from InfluenzaA__AFN19549__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaagggggagaucugcaacucgccccaccagauccucgacggcgggaacugcacccugaucgacgcccugcucggcgacccccagugcgacggcuuccagaacaagaagugggaccuguucguggagcgcuccaaggcccacuccaacugcuaccccuacgacgugccggacuacgcgucgcugcggucccucgucgccagcuccgggacccuggaguucaacaacgagucguucaacuggacgggcgugacccagaacgggaccuccagcgccugcaugcgccgguccaacaacucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccucgggccggaucaccguguccaccaagcgcagccagcaggccgugaucccgaacaucggcucgcggccccgcguccggaacauccccucccgcgugucgaucuacuggacgaucgugaagcccggggacauccugcucaucaacuccaccggcaaccugaucgccccgcggggguacuucaagauccgcagcggcaaguccucgaucaugcgguccgacgcccccaucggcaagugcaacagcgcgugcaucacccccaacggguccauccccaacgacaagccguuccagaacgucaaccgcaucaccuacggcgccugcccccgguacgugaagcagaacacgcugaagcucgccaccgggaugcgcaacgugcccgagaagcagacccggggcaucuucggggccaucgccggcuucaucgagaacggcugggaggggauggucgacggcugguacggguuccgccaccagaacucggagggccgggggcaggcggccgaccugaaguccacccaggccgccaucgaccagaucaacggcaagcugaaccgccucaucggcaagacgaacgagaaguuccaccagaucgagaaggaguucucggagguggaggggcggauccaggacaucgagaaguacguggaggacaccaagaucgaccugugguccuacaacgccgagcugcucgucgcgcuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcucaagucgggcuacaaggacuggauccuguggaucuccuucgccaucagcugcuuccugcucugcgucgcgcugcugggguucaucaugugggccugccagaagggcaacauccggugcaacaucugcaucuga

SEQ ID NO: 9748 - RNA, 1701 nt, Artificial Sequence
  derived and/or modified CDS sequence (AUadapt) from InfluenzaA__AFN19551__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccacugcgacggcuuccagaacaagaagugggaccucuucguggagcgcuccaaggccuacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccaacucguccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaguccucggggcggaucaccgugagcacgaagcgcucccagcaggccgugaucccgaacaucggcucgcggccccgcauccggaacauccccucccgcaucagcaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucacguacggggccugcccccgguacgugaagcagagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacaaccacgacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 9749 - RNA, 1701 nt, Artificial Sequence; identical to SEQ ID NO: 9698
  derived and/or modified CDS sequence (AUadapt) from InfluenzaA__AFN19553__HA

SEQ ID NO: 9750 - RNA, 1701 nt, Artificial Sequence; identical to SEQ ID NO: 9698
  derived and/or modified CDS sequence (AUadapt) from InfluenzaA__AFN19555__HA

SEQ ID NO: 9751 - RNA, 1701 nt, Artificial Sequence; identical to SEQ ID NO: 9319
  derived and/or modified CDS sequence (AUadapt) from InfluenzaA__AFN19557__HA

SEQ ID NO: 9752 - RNA, 1701 nt, Artificial Sequence; identical to SEQ ID NO: 9698
  derived and/or modified CDS sequence (AUadapt) from InfluenzaA__AFN19559__HA

SEQ ID NO: 9753 - RNA, 1701 nt, Artificial Sequence; identical to SEQ ID NO: 9706
  derived and/or modified CDS sequence (AUadapt) from InfluenzaA__AFN19561__HA

SEQ ID NO: 9754 - RNA, 1701 nt, Artificial Sequence
  derived and/or modified CDS sequence (AUadapt) from InfluenzaA__AFN19563__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccucggggcgcaucaccguguccaccaagcggagccagcaggccgugaucccgaacaucggcucgcgcccccggauccgcaacauccccucccggaucagcaucuacuggacgaucgucaagcccggcgacauccugcucaucaacuccaccgggaaccugaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacgacguguaccgcgacgaggcccucaacaaccgguuccagaucaagggggucgagcugaaguccggcuacaaggacuggauccuguggaucagcuucgccaccuccugcuuccuccugugcguggcccugcucggcuucaucaugugggccugccagaaggggaacauccgcugcaacaucugcaucuga

SEQ ID NO: 9755 - RNA, 1701 nt, Artificial Sequence; identical to SEQ ID NO: 9676
  derived and/or modified CDS sequence (AUadapt) from InfluenzaA__AFN19565__HA

SEQ ID NO: 9756 - RNA, 1701 nt, Artificial Sequence
  derived and/or modified CDS sequence (AUadapt) from InfluenzaA__AFN19567__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcaacaacuccuucuucucgcggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgguuccagaucaagggggucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 9757 - RNA, 1701 nt, Artificial Sequence; identical to SEQ ID NO: 9319
  derived and/or modified CDS sequence (AUadapt) from InfluenzaA__AFN19569__HA

SEQ ID NO: 9758 - RNA, 1701 nt, Artificial Sequence
  derived and/or modified CDS sequence (AUadapt) from InfluenzaA__AFN19571__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacucguccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacucccagucgagcgggcggaucaccguguccacgaagcgcucgcagcaggcggugaucccgaacaucggcucccggccccgcauccggaacauccccagccgcaucuccaucuacuggaccaucgucaagcccggcgacauccugcucaucaacucgaccgggaaccugaucgccccgcggggcuacuuccgcauccgguccgggaaguccuccaucaugcgcagcgacgcccccaucggcaagugcaacuccgagugcaucacccccaacggcucgauccccaacgacaagccguuccagaacgugaaccggaucacguacgggcccugcccccgcuacgugaagcaguccacccugaagcucgccaccggcaugcggaacguccccgagaagcagacccgcgggaucuucggcgccaucgcgggguucaucgagaacggcugggagggcaugguggacgggugguacggcuaccggcaccagaacagcgaggggcgcggccaggccgccgaccugaaguccacgcaggccgccaucgaccagaucaacgggaagcugaaccggcucaucggcaagaccaacgagaaguuccaccagaucgagaaggaguucucggagguggagggccgcauccaggaccuggagaaguacgucgaggacaccaagaucgaccuguggaccuacaacgcggagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccggaacggcaccuacaaccacgacguguaccgcgacgaggcccucaacaaccgguuccagaucaagggggucgagcugaaguccggcuacaaggacuggauccuguggaucucguucgcgaucagcugcuuccuccugugcguggcccugcucggcuucaucaugugggccugccagaaggggaacauccgcugcaacaucugcaucuga

SEQ ID NO: 9759 - RNA, 1701 nt, Artificial Sequence
  derived and/or modified CDS sequence (AUadapt) from InfluenzaA__AFN19573__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggaagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacaacgagagcuucaacuggaccggggugacccagaacggcaccuccucggccugcauccgccgguccaagaacagcuucuucucccgccugaacuggcucacgcaccugaacuucaaguacucggcccugaacgugaccaugcccaacaaggagcaguucgacaagcucuacaucuggggcguccaccaccccgggaccgacaaggaccagaucucccuguacgcgcaggccucggggcggaucaccgugagcacgaagcgcucccagcagaccgugauccccaacaucggcucgcggccgcgcguccggaacauccccucccgcaucagcaucuacuggaccaucgugaagcccggcgacauccugcucaucaacuccaccgggaaccugaucgcgccccggggcuacuucaagaugcagucggggaaguccucgaucaugcgcuccgacgccccgaucggcaagugcaacagcgagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 9760 - RNA, 1701 nt, Artificial Sequence
  derived and/or modified CDS sequence (AUadapt) from InfluenzaA__AFN19575__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacaacccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccucggggcggaucaccguguccacgaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucacguacggggccugcccccgguacgucaagcagagcacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9761 - RNA, 1701 nt, Artificial Sequence; identical to SEQ ID NO: 9675
  derived and/or modified CDS sequence (AUadapt) from InfluenzaA__AFN19577__HA

SEQ ID NO: 9762 - RNA, 1701 nt, Artificial Sequence; identical to SEQ ID NO: 9675
  derived and/or modified CDS sequence (AUadapt) from InfluenzaA__AFN19579__HA

SEQ ID NO: 9763 - RNA, 1701 nt, Artificial Sequence; identical to SEQ ID NO: 9675
  derived and/or modified CDS sequence (AUadapt) from InfluenzaA__AFN19581__HA

SEQ ID NO: 9764 - RNA, 1701 nt, Artificial Sequence; identical to SEQ ID NO: 9675
  derived and/or modified CDS sequence (AUadapt) from InfluenzaA__AFN19583__HA

SEQ ID NO: 9765 - RNA, 1701 nt, Artificial Sequence
  derived and/or modified CDS sequence (AUadapt) from InfluenzaA__AFN19587__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacggggugaacugcacccugaucgacgcccugcucggcgacccccagugcgacggguuccagaacaagaagugggaccuguucguggagcgcucgaaggccuacuccaacugcuaccccuacgacgucccggacuacgcgagccugcggucccucguggccucguccggcacgcuggaguucaacaacgagagcuucaacuggaccggcgugacccagaacgggaccuccagcgccugcauccgccgguccaacucguccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccucgggccggaucaccgugagcacgaagcgcucccagcaggccgucaucccgaacaucgggucgcggccccgcauccggaacauccccucccgcaucagcaucuacuggaccaucgugaagcccggcgacauccugcucaucaacuccaccggcaaccugaucgccccgcggggguacuucaagauccgcagcggcaaguccucgaucaugcgguccgacgcccccaucgggaagugcaacagcgagugcaucacccccaacggcuccauccccaacgacaagccguuccagaacgugaaccgcaucacguacggcgccugcccccgguacgucaagcagucgacccugaagcucgcgaccgggaugcgcaacgugcccgagaagcagacccggggcaucuucggggccaucgccggcuucaucgagaacgggugggagggcaugguggacggcugguacggguuccgccaccagaacuccgagggccgggggcaggccgccgaccugaaguccacgcaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacgagugcgacaacgcgugcaucggcucgauccgcaacgggaccuacaaccacgacgucuaccgggacgaggcccucaacaaccgcuuccagaucaagggcguggagcugaaguccggguacaaggacuggauccuguggaucagcuucgccaucagcugcuuccuccugugcguggcccugcucggcuucaucaugugggccugccagaagggcaacauccggugcaacaucugcaucuga

SEQ ID NO: 9766 - RNA, 1701 nt, Artificial Sequence; identical to SEQ ID NO: 9675
  derived and/or modified CDS sequence (AUadapt) from InfluenzaA__AFN19589__HA

SEQ ID NO: 9767 - RNA, 1701 nt, Artificial Sequence
  derived and/or modified CDS sequence (AUadapt) from InfluenzaA__AFN19591__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcaugcgccggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaacgggaacauccggugcaacaucugcaucuga

SEQ ID NO: 9768 - RNA, 1701 nt, Artificial Sequence; identical to SEQ ID NO: 9675
  derived and/or modified CDS sequence (AUadapt) from InfluenzaA__AFN19593__HA

SEQ ID NO: 9769 - RNA, 1701 nt, Artificial Sequence; identical to SEQ ID NO: 9676
  derived and/or modified CDS sequence (AUadapt) from InfluenzaA__AFN19595__HA

SEQ ID NO: 9770 - RNA, 1701 nt, Artificial Sequence; identical to SEQ ID NO: 9676
  derived and/or modified CDS sequence (AUadapt) from InfluenzaA__AFN19599__HA

SEQ ID NO: 9771 - RNA, 1701 nt, Artificial Sequence; identical to SEQ ID NO: 9738
  derived and/or modified CDS sequence (AUadapt) from InfluenzaA__AFN19601__HA

SEQ ID NO: 9772 - RNA, 1701 nt, Artificial Sequence; identical to SEQ ID NO: 9319
  derived and/or modified CDS sequence (AUadapt) from InfluenzaA__AFN19607__HA

SEQ ID NO: 9773 - RNA, 1701 nt, Artificial Sequence; identical to SEQ ID NO: 9675
  derived and/or modified CDS sequence (AUadapt) from InfluenzaA__AFN19609__HA

SEQ ID NO: 9774 - RNA, 1701 nt, Artificial Sequence
  derived and/or modified CDS sequence (AUadapt) from InfluenzaA__AFN19611__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgccggagcaacaacuccuucuucucgcgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccguguccaccaagcgcucgcagcaggccgugaucccgaacaucggcagccggccccgcauccggaacauccccucccgcaucucgaucuacuggacgaucgucgagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucaccuacggggccugcccccgguacgugaagcagucgacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 9775 - RNA, 1701 nt, Artificial Sequence; identical to SEQ ID NO: 9698
  derived and/or modified CDS sequence (AUadapt) from InfluenzaA__AFN19613__HA

SEQ ID NO: 9776 - RNA, 1701 nt, Artificial Sequence; identical to SEQ ID NO: 9676
  derived and/or modified CDS sequence (AUadapt) from InfluenzaA__AFN19617__HA

SEQ ID NO: 9777 - RNA, 1701 nt, Artificial Sequence
  derived and/or modified CDS sequence (AUadapt) from InfluenzaA__AFN19619__HA
augaagaccaucaucgcccugucgcacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagcaagccccggauccgcaacauccccucccggaucucgaucuacuggaccaucgucaagcccggcgacauccugcucaucaacuccaccgggaaccugaucgccccgcgcggcuacuucaagauccggagcgggaaguccucgaucaugcgcuccgacgcccccaucggcaagugcaacagcgagugcaucacccccaacggcuccauccccaacgacaagccguuccagaacgugaaccggaucacguacggggccugcccccgcuacgugaagcagucgacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacgcaggcggccaucgaccagaucaacgggaagcugaaccggcucaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacaaccacgacguguaccgcgacgaggcccucaacaaccgguuccagaucaagggggucgagcugaaguccggcuacaaggacuggauccuguggaucagcuucgccaucagcugcuuccuccugugcguggugcugcucggcuucaucaugugggccugccagaaggggaacauccgcugcaacaucugcaucuga

SEQ ID NO: 9778 - RNA, 1701 nt, Artificial Sequence; identical to SEQ ID NO: 9738
  derived and/or modified CDS sequence (AUadapt) from InfluenzaA__AFN19623__HA

SEQ ID NO: 9779 - RNA, 1701 nt, Artificial Sequence; identical to SEQ ID NO: 9675
  derived and/or modified CDS sequence (AUadapt) from InfluenzaA__AFN19629__HA

SEQ ID NO: 9780 - RNA, 1701 nt, Artificial Sequence
  derived and/or modified CDS sequence (AUadapt) from InfluenzaA__AFN19631__HA
augaagaccaucaucgcccugucguacauccucugccugguguucgcccagaagcugcccgagaacgacuacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacgggaucaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccagcuccggcacgcuggaguucaacaacgagucguucaacuggaccggcgugacccagaacgggaccuccagcgccugcauccgccgguccacgucguccuucuucagccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcagccguccggccggaucacggugagcaccaagcgcucgcagcaggccgugauccccaacaucgggucccggccccgcauccggaacauccccagccgcaucuccaucuacuggaccaucgucaagccgggcgacauccugcucaucaacucgaccggcaaccugaucgcgccccggggguacuucaagauccgcuccggcaagagcuccaucaugcggagcgacgcccccaucgggaagugcaacuccgagugcaucacgcccaacggcucgaucccgaacgacaagcccuuccagaacgugaaccgcaucaccuacggcgccugcccccgguacgugaagcaguccacccugaagcucgccaccgggaugcgcaacguccccgagaagcagacgcggggcaucuucggggccaucgccggcuucaucgagaacgggugggagggcaugguggacggcugguacggguuccgccaccagaacagcgagggccgggggcaggccgccgaccugaaguccacccaggcggccaucgaccagaucaacggcaagcugaaccgccucaucgggaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacaaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 9781 - RNA, 1701 nt, Artificial Sequence
  derived and/or modified CDS sequence (AUadapt) from InfluenzaA__AFN19633__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccaucucgacgaagcgcucccagcaggccgugaucccgaacaucggcagccggccccgcauccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgucaaccgcaucacguacggggccugcccccgguacgugaagcagucgacccugaagcucgcgaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 9782 - RNA, 1701 nt, Artificial Sequence
  derived and/or modified CDS sequence (AUadapt) from InfluenzaA__AFN19635__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacgggaucaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggcgugacccagaacgggaccuccucggccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagccguccggccggaucaccgugucgacgaagcgcagccagcaggccgugauccccaacaucgggucccggccccgcauccggaacauccccucgcgcaucuccaucuacuggaccaucgucaagccgggcgacauccugcucaucaacagcaccggcaaccugaucgcgccccggggguacuucaagauccgcuccggcaagucguccaucaugcggagcgacgcccccaucgggaagugcaacuccgagugcaucacccccaacggcucgaucccgaacgacaagcccuuccagaacgugaaccgcaucacguacggcgccugcccccgguacgugaagcaguccacccugaagcucgccaccgggaugcgcaacguccccgagaagcagacccggggcaucuucggggccaucgccggcuucaucgagaacgggugggagggcaugguggacggcugguacggguuccgccaccagaacagcgagggccgggggcaggccgccgaccugaaguccacgcaggcggccaucgaccagaucaacggcaagcugaaccgccucaucgggaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacaaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 9783 - RNA, 1701 nt, Artificial Sequence; identical to SEQ ID NO: 9782
  derived and/or modified CDS sequence (AUadapt) from InfluenzaA__AFN19637__HA

SEQ ID NO: 9784 - RNA, 1701 nt, Artificial Sequence; identical to SEQ ID NO: 9319
  derived and/or modified CDS sequence (AUadapt) from InfluenzaA__AFN19639__HA

SEQ ID NO: 9785 - RNA, 1701 nt, Artificial Sequence; identical to SEQ ID NO: 9738
  derived and/or modified CDS sequence (AUadapt) from InfluenzaA__AFN19641__HA

SEQ ID NO: 9786 - RNA, 1701 nt, Artificial Sequence; identical to SEQ ID NO: 9782
  derived and/or modified CDS sequence (AUadapt) from InfluenzaA__AFN19643__HA

SEQ ID NO: 9787 - RNA, 1701 nt, Artificial Sequence; identical to SEQ ID NO: 9319
  derived and/or modified CDS sequence (AUadapt) from InfluenzaA__AFN19645__HA

SEQ ID NO: 9788 - RNA, 1701 nt, Artificial Sequence
  derived and/or modified CDS sequence (AUadapt) from InfluenzaA__AFN19647__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacggggugaacugcacccugaucgacgcccugcucggcgacccccagugcgacggguuccagaacaagaagugggaccuguucguggagcgcucgaaggccuacuccaacugcuaccccuacgacgucccggacuacgcgagccugaagucccucguggccucguccggcacgcuggaguucaacaacgagagcuucaacuggaccggcgugacccagaacgggaccuccagcgccugcauccggcgcuccaacucguccuucuucagccggcugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccucgggccgcaucaccgugagcacgaagcggucccagcaggccgucaucccgaacaucgggucgcgcccccggauccgcaacauccccucccggaucagcaucuacuggaccaucgugaagcccggcgacauccugcucaucaacuccaccggcaaccugaucgccccgcgcggguacuucaagauccagagcggcaaguccucgaucaugcgguccgacgcccccaucgggaagugcaacagcgagugcaucacccccaacggcuccauccccaacgacaagccguuccagaacgugaaccgcaucacguacggcgccugcccccgguacgucaagcagucgacccugaagcucgcgaccgggaugcgcaacgugcccgagaagcagacccggggcaucuucggggccaucgccggcuucaucgagaacgggugggagggcaugguggacggcugguacggguuccgccaccagaacuccgagggccgggggcaggccgccgaccugaaguccacgcaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgcgugcaucggcucgauccggaacgggaccuacaaccacgacgucuaccgcgacgaggcccucaacaaccgcuuccagaucaagggcguggagcugaaguccggguacaaggacuggauccuguggaucagcuucgccaucagcugcuuccuccugugcguggcccugcucggcuucaucaugugggccugccagaagggcaacauccggugcaacaucugcaucuga

SEQ ID NO: 9789 - RNA, 1701 nt, Artificial Sequence
  derived and/or modified CDS sequence (AUadapt) from InfluenzaA__AFN19649__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucucggagaucugcgacagcccccaccagauccucgacggggagaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggacgggcgugacccagaacgggaccuccagcgccugcauccgccgguccaacucguccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccucgggccggaucaccgugagcaccaagcgcucccagcaggccgugaucccgaacaucgggucgcggccccgcauccggaacauccccucccgcaucagcaucuacuggacgaucgucaagcccggcgacauccugcucaucaacuccaccggcaaccugaucgccccgcggggguacuucaagauccgcagcggcaaguccucgaucaugcgguccgacgcccccaucgggaagugcaacagcgagugcaucacccccaacggcuccauccccaacgacaagccguuccagaacgugaaccgcaucaccuacggcgccugcccccgguacgugaagcagucgacgcugaagcucgcgaccgggaugcgcaacguccccgagaagcagacccggggcaucuucggggccaucgccggcuucaucgagaacgggugggagggcaugauggacggcugguacggguuccgccaccagaacuccgagggccgggggcaggccgccgaccugaaguccacccaggcggccaucgaccagaucaacggcaagcugaaccgccucaucgggaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcguggagcugaaguccggguacaaggacuggauccuguggaucagcuucgccaucagcugcuuccuccugugcgucgcccugcucggcuucaucaugugggccugccagaagggcaacauccggugcaacaucugcaucuga

SEQ ID NO: 9790 - RNA, 1701 nt, Artificial Sequence; identical to SEQ ID NO: 9782
  derived and/or modified CDS sequence (AUadapt) from InfluenzaA__AFN19653__HA

SEQ ID NO: 9791 - RNA, 1701 nt, Artificial Sequence; identical to SEQ ID NO: 9698
  derived and/or modified CDS sequence (AUadapt) from InfluenzaA__AFN19663__HA

SEQ ID NO: 9792 - RNA, 1701 nt, Artificial Sequence; identical to SEQ ID NO: 9706
  derived and/or modified CDS sequence (AUadapt) from InfluenzaA__AFN19665__HA

SEQ ID NO: 9793 - RNA, 1701 nt, Artificial Sequence
  derived and/or modified CDS sequence (AUadapt) from InfluenzaA__AFN19667__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcaugcgccggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 9794 - RNA, 1701 nt, Artificial Sequence
  derived and/or modified CDS sequence (AUadapt) from InfluenzaA__AFN19669__HA
augaagaccaucaucgcccugucguacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccgaacuacgcgucccugcggucgcuggucgccuccagcggcacccucgaguucaacaacgaguccuucaacuggacgggggugacccagaacggcaccucguccgccugcaugcgccggagcaacuccucguucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcugaucaacucgaccgggaaccucaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucaccuacggggccugcccccgguacgugaagcaguccacgcugaagcuggcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccucaaguccacccaggcggccaucgaccagaucaacgggaagcugaaccgccugaucggcaagacgaacgagaaguuccaccagaucgagaaggaguucagcgagguggagggccggauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 9795 - RNA, 1701 nt, Artificial Sequence
  derived and/or modified CDS sequence (AUadapt) from InfluenzaA__AFN19671__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgagagcauccggaacgggaccuacgaccacgacguguaccgcgacgaggcccucaacaaccgguuccagaucaagggcgucgagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 9796 - RNA, 1701 nt, Artificial Sequence; identical to SEQ ID NO: 9319
  derived and/or modified CDS sequence (AUadapt) from InfluenzaA__AFN19674__HA

SEQ ID NO: 9797 - RNA, 1701 nt, Artificial Sequence; identical to SEQ ID NO: 9319
  derived and/or modified CDS sequence (AUadapt) from InfluenzaA__AFN19676__HA

SEQ ID NO: 9798 - RNA, 1701 nt, Artificial Sequence; identical to SEQ ID NO: 9706
  derived and/or modified CDS sequence (AUadapt) from InfluenzaA__AFN19678__HA

SEQ ID NO: 9799 - RNA, 1701 nt, Artificial Sequence
  derived and/or modified CDS sequence (AUadapt) from InfluenzaA__AFN19682__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccgaacuacgcgucccugcggucgcucgucgccuccagcggcacccuggaguucaacaacgaguccuucaacuggacgggggugacccagaacggcaccucguccgccugcaugcgccggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacaucaagugcaacaucugcaucuga

SEQ ID NO: 9800 - RNA, 1701 nt, Artificial Sequence
  derived and/or modified CDS sequence (AUadapt) from InfluenzaA__AFN19684__HA
augaagaccaucaucgcccugucguacauccucugccuggccuucgcgcagaagcugcccggcaacgacaacuccaccgccacgcucugccuggggcaccacgccgugccgaacggcaccaucgucaagaccaucaccaacgaccagaucgaggugacgaacgccaccgagcuggugcagucguccagcaccggggagaucugcgacucgccccaccagauccucgacggcgagaacugcacccugaucgacgcccugcucggggacccccagugcgacggcuuccagaacaagaagugggaccuguucgucgagcgcagcaaggcguacuccaacugcuaccccuacgacgugccggacuacgccucgcugcggucccucguggccagcuccggcacgcuggaguucaacaacgagucguucaacuggaccggggucacccagaacggcaccuccagcgccugcauccgcggguccaacucguccuucuucagccggcugaacuggcucacgcaccugaacuucaaguaccccgcgcugaacgugaccaugcccaacaacgagcaguucgacaagcucuacaucuggggcgugcaccaccccgggaccgacaaggaccagaucuuccuguacgcccaguccucgggccgcaucaccgucagcacgaagcggucccagcaggccgugaucccgaacaucggcucgcgcccccggauccgcaacauccccucccggaucagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggagugcaucacccccaacggguccauccccaacgacaagccguuccagaacgucaaccggaucacguacggcgcgugcccccgcuacgugaagcagagcacccugaagcucgccaccgggaugcggaacgugcccgagaagcagacccgcggcaucuucggggccaucgccggcuucaucgagaacggcugggaggggauggucgacggcugguacggguuccggcaccagaacuccgagggccgcgggcaggccgcggaccugaaguccacgcaggccgccaucgaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucacggacuccgagaugaacaagcuguucgagaagaccaagaagcagcugcgggagaacgcggaggacaugggcaacgggugcuucaagaucuaccacaagugcgacaacgccugcaucggcagcauccgcaacgggaccuacaaccacaacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggcgugccagaagggcaacauccgcugcaacaucugcaucuga

SEQ ID NO: 9801 - RNA, 1701 nt, Artificial Sequence
  derived and/or modified CDS sequence (AUadapt) from InfluenzaA__AFN19686__HA
augaagaccaucaucgcccugucguacauccucugccuggccuucgcgcagaagcugcccggcaacgacaacuccaccgccacgcucugccuggggcaccacgccgugccgaacggcaccaucgucaagaccaucaccaacgaccagaucgaggugacgaacgccaccgagcuggugcagucguccagcaccggggagaucugcgacucgccccaccagauccucgacggcgagaacugcacccugaucgacgcccugcucggggacccccagugcgacggcuuccagaacaagaagugggaccuguucgucgagcgcagcaaggcguacuccaacugcuaccccuacgacgugccggacuacgccucgcugcggucccucguggccagcuccggcacgcuggaguucaacaacgagucguucaacuggaccggggucacccagaacggcaccuccagcgccugcauccgccgguccaacucguccuucuucagccgccugaacuggcucacgcaccugaacuucaaguaccccgcgcugaacgugaccaugcccaacaacgagcaguucgacaagcucuacaucuggggcgugcaccaccccgggaccgacaaggaccagaucuuccuguacgcccaguccucggggcggaucaccgucagcacgaagcgcucccagcaggccgugaucccgaacaucggcucgcggccccgcauccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgucaaccgcaucacguacggggcgugcccccgguacgugaagcagagcacccugaagcucgccaccggcaugcgcaacauccccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggucguacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacaaccacaacgucuaccgggacgaggcccucaacaaccgcuuccagaucaaggggguggagcugaaguccggcuacaaggacuggauccuguggaucucguucgccaucagcugcuuccuccugugcguggcccugcucggcuucaucaugugggcgugccagaaggggaacauccggugcaacaucugcaucuga

SEQ ID NO: 9802 - RNA, 1701 nt, Artificial Sequence
  derived and/or modified CDS sequence (AUadapt) from InfluenzaA__AFN19688__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 9803 - RNA, 1701 nt, Artificial Sequence
  derived and/or modified CDS sequence (AUadapt) from InfluenzaA__AFN19690__HA
augaagaccaccaucgcccugucguacauccucugccugguguucgcccagaagcugcccggcaacgacaacuccacggcgacccucugccuggggcaccacgccgucccgaacggcaccaucgugaagaccaucacgaacgaccgcaucgaggugaccaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacgcuggaguucaacaacgaguccuucaacuggaccggggugacccagaacggcaccagcuccgccugcauccggcgcucgaacaacuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccucggggcgcaucaccguguccacgaagcggagccagcaggccgugaucccgaacaucggcucgcgcccccggauccgcaacauccccucccggaucagcaucuacuggaccaucgucaagcccggcgacauccugcucaucaacuccaccgggaaccugaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcagagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacgaccacgacguguaccgcgacgaggcccucaacaaccgguuccagaucaagggggucgaccugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 9804 - RNA, 1701 nt, Artificial Sequence
  derived and/or modified CDS sequence (AUadapt) from InfluenzaA__AFN19692__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcgagaacugcacccucaucgacgcccugcugggggacccccagugcgacggcuuccagaacaagaagugggaccucuucguggagcgcagcaaggccuacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccgacucguccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugucgacgaagcgcagccagcaggccgugaucccgaacaucggcucccggccccgcauccggaacauccccucgcgcaucuccaucuacuggaccaucgucaagcccggcgacauccugcugaucaacagcaccgggaaccucaucgccccgcggggcuacuucaagauccgcuccgggaaguccuccaucaugcggucggacgcccccaucggcaagugcaacuccgagugcaucacccccaacggcagcauccccaacgacaagccguuccagaacgugaaccgcaucacguacggggcgugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacaaccacgacguguaccgggacgaggcccugaacaaccgcuuccagaucaagggggucgagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 9805 - RNA, 1701 nt, Artificial Sequence
  derived and/or modified CDS sequence (AUadapt) from InfluenzaA__AFN19694__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucgcccaucggggagaucugcgacagcccccaccagauccucgacggcgagaacugcacccugaucgacgcccugcucggggacccccagugcgacggcuuccagaacaagaagugggaccuguucguggagcggucgaaggccuacuccaacugcuacccguacgacgugcccgacuacgcgagccugcgcucccucgucgccucguccggcacccuggaguucaacaacgagagcuucaacuggacgggggugacccagaacggcaccuccucggccugcauccggcgcuccaacaacagcuucuucucccggcugaacuggcucacccaccugaacuucaaguaccccgcccugaacgugacgaugcccaacaacgagcaguucgacaagcucuacaucuggggcguccaccacccggggaccgacaaggaccagaucuuccuguacgcgcagucguccgggcgcaucaccgugagcaccaagcggucccagcaggccgugauccccaacaucggcucgcgcccccggauccgcaacauccccagccggaucuccaucuacuggacgaucgucaagccgggcgacauccugcucaucaacucgaccgggaaccugaucgcgccccgcggcuacuucaagauccgguccgggaaguccuccaucaugcgcagcgacgcccccaucggcaagugcaaguccgagugcaucacccccaacggcucgaucccgaacgacaagcccuuccagaacgugaaccggaucaccuacggggccugcccccgcuacgugaagcaguccacgcugaagcucgccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 9806 - RNA, 1701 nt, Artificial Sequence
  derived and/or modified CDS sequence (AUadapt) from InfluenzaA__AFN19700__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgagcgcuucaacugguccggggugacgcagaacggcaccucguccgccugcaugcggcgcagcaacuccucguucuucucccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggaccaucgucaagcccggcgacauccugcucaucaacucgacggggaaccugaucgccccgcgcggcuacuucaagauccgguccggcaagagcuccaucaugcgcucggacgcccccaucgggaagugcaacuccgagugcaucacccccaacggcagcauccccaacgacaagccguuccagaacgugaaccggaucaccuacggggccugcccccgcuacgugaagcaguccacccugaagcucgcgacgggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 9807 - RNA, 1701 nt, Artificial Sequence
  derived and/or modified CDS sequence (AUadapt) from InfluenzaA__AFN19702__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcggggcaaggccuacuccaacugcuaccccuacgacgugccggacuacgcgucgcugcgcucccucgucgccagcuccgggacccuggaguucaacaacgagucguucaacuggacgggcgugacccagaacgggaccuccagcgccugcauccggcgcuccaacaacucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugucgaccaagcggucccagcaggccgugaucccgaacaucggcagccgcccccggauccgcaacauccccucgcggaucuccaucuacuggacgaucgucaagcccggggacauccugcucaucaacagcaccggcaaccugaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucucggagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagucgggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 9808 - RNA, 1701 nt, Artificial Sequence; identical to SEQ ID NO: 7060
  derived and/or modified CDS sequence (AUadapt) from InfluenzaA__AFN19709__HA

SEQ ID NO: 9809 - RNA, 1701 nt, Artificial Sequence
  derived and/or modified CDS sequence (AUadapt) from InfluenzaA__AFN19719__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcacccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcgucuaccagauccuggccaucuacuccaccguggcgucgucccuggugcucgucgugagccugggggccaucucguucuggaugugcuccaacggcagccugcagugccggaucugcaucuga

SEQ ID NO: 9810 - RNA, 1701 nt, Artificial Sequence; identical to SEQ ID NO: 6680
  derived and/or modified CDS sequence (AUadapt) from InfluenzaA__AFN19730__HA

SEQ ID NO: 9811 - RNA, 1701 nt, Artificial Sequence; identical to SEQ ID NO: 7060
  derived and/or modified CDS sequence (AUadapt) from InfluenzaA__AFN19736__HA

SEQ ID NO: 9812 - RNA, 1701 nt, Artificial Sequence
  derived and/or modified CDS sequence (AUadapt) from InfluenzaA__AFN19748__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaccgggaacucguaccccaagcuguccaagagcuacaucaacgacaagggcaaggaggugcugguccucugggggauccaccaccccucgacgaccgccgaccagcagucccuguaccagaacgccgacaccuacguguucgugggcaccucgcgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacgcagaacgccaucgacaagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 9813 - RNA, 1701 nt, Artificial Sequence; identical to SEQ ID NO: 7069
  derived and/or modified CDS sequence (AUadapt) from InfluenzaA__AFN19757__HA

SEQ ID NO: 9814 - RNA, 1701 nt, Artificial Sequence; identical to SEQ ID NO: 7060
  derived and/or modified CDS sequence (AUadapt) from InfluenzaA__AFN19768__HA

SEQ ID NO: 9815 - RNA, 1701 nt, Artificial Sequence
  derived and/or modified CDS sequence (AUadapt) from InfluenzaA__AFN19781__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccguggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcggcucgccaccggccugcgcaacgugccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggccaucuacuccaccguggcgucgucccuggugcucgucgugagccugggggccaucucguucuggaugugcuccaacggcagccugcagugccggaucugcaucuga

SEQ ID NO: 9816 - RNA, 1701 nt, Artificial Sequence
  derived and/or modified CDS sequence (AUadapt) from InfluenzaA__AFN19791__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucaacuacgaggagcuccgggagcagcugagcuccgugucguccuucgagcgcuucgagaucuuccccaagacgagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccuccaaguacagcaagaaguucaagcccgagaucgccguccggccgaaggugcgcgaccaggagggccggaugaacuacuacuggacgcugguggagcccggggacaagaucaccuucgaggcgaccggcaaccuccuggucccccgcuacgccuucgccauggagcggaacgccggguccggcaucaucaucucggacacccccgugcacgacugcaacacgaccugccagaccccggagggcgccaucaacaccucccugcccuuccagaacauccaccccaucacgaucgggaagugccccaaguacgucaagagcaccaagcuccgccuggcgaccggccugcggaacgugccguccauccagucgcgcggccucuucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcggaucgagaaccugaacaagaaggucgacgacggcuuccuggacaucuggacguacaacgccgagcugcucgugcugcuggagaacgagcgcacccucgacuaccacgacucgaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagucgacccggaucuaccagauccuggcgaucuacuccaccgucgccagcucgcucgugcugaucgugucccugggggccaucagcuucuggaugugcuccaacggcagccuccagugccgcaucugcaucuga

SEQ ID NO: 9817 - RNA, 1701 nt, Artificial Sequence; identical to SEQ ID NO: 7060
  derived and/or modified CDS sequence (AUadapt) from InfluenzaA__AFN19806__HA

SEQ ID NO: 9818 - RNA, 1701 nt, Artificial Sequence
  derived and/or modified CDS sequence (AUadapt) from InfluenzaA__AFN19808__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccaacagcugguccuacaucguggagaccucguccucggacaacggcacgugcuaccccggcgacuucaucgacuacgaggagcuccgggagcagcuguccagcguguccucguucgagcgcuucgagaucuuccccaagaccaacuccuggcccaaccacgacagcaacaagggggucaccgccgccugcccgcacgccggcgcgaaguccuucuacaagaaccugaucuggcucgugaagaaggggaacucguaccccaagcuguccaagucguacaucaacgacaagggcaaggaggugcugguccucugggggauccaccaccccuccaccagcgccgaccagcagucgcuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgugaacucgaccaagcugcggcucgccaccggccugcgcaacgugccguccauccagagccgggggcuguucggcgccaucgccggguucaucgagggcggcuggacggggauggucgacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagucgacccgcaucuaccagauccuggccaucuacuccaccguggccucgucccugguccucguggugagccugggggccaucucguucuggaugugcuccaacggcagccugcagugccggaucugcaucuga

SEQ ID NO: 9819 - RNA, 1701 nt, Artificial Sequence; identical to SEQ ID NO: 7069
  derived and/or modified CDS sequence (AUadapt) from InfluenzaA__AFN19814__HA

SEQ ID NO: 9820 - RNA, 1701 nt, Artificial Sequence
  derived and/or modified CDS sequence (AUadapt) from InfluenzaA__AFN19816__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcgacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 9821 - RNA, 1701 nt, Artificial Sequence
  derived and/or modified CDS sequence (AUadapt) from InfluenzaA__AFN19821__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaagcugaagcccgagaucgccauccgcccgaagguccgggaccaggagggccgcaugaacuacuacuggacccucguggagcccgggggcaagaucacguucgaggccaccgggaaccugguggucccccgguacgcguucgccauggagcgcaacgccggcagcggcaucaucaucuccgacacccccgugcacgacugcaacaccacgugccagaccccgaagggggccaucaacaccucgcugcccuuccagaacauccaccccaucaccaucggcaagugccccaaguacgugaaguccacgaagcuccggcuggccaccgggcugcgcaacgucccgagcauccagucccggggccucuucggggcgaucgccggcuucaucgagggcggguggaccggcaugguggacgggugguacggcuaccaccaccagaacgagcaggggucgggcuacgccgccgaccugaaguccacccagaacgccaucgacaagaucacgaacaaggugaacucggucaucgagaagaugaacacccaguucaccgcggugggcaaggaguucaaccaccuggagaagcgcaucgagaaccucaacaagaaggucgacgacggguuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcucaaccgggaggagaucgacggggugaagcuggagucgacccgcaucuaccagauccuggccaucuacuccaccgucgcgucgucccucgugcugguggucagccugggcgccaucucguucuggaugugcuccaacggcagccuccagugccggaucugcaucuga

SEQ ID NO: 9822 - RNA, 1701 nt, Artificial Sequence; identical to SEQ ID NO: 6680
  derived and/or modified CDS sequence (AUadapt) from InfluenzaA__AFN19831__HA

SEQ ID NO: 9823 - RNA, 1701 nt, Artificial Sequence
  derived and/or modified CDS sequence (AUadapt) from InfluenzaA__AFN19849__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcaggccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagucgacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucggggacggcugcuucgaguucuaccacaagugcgacaacacgugcauggagucggugaagaacgggaccuacgacuaccccaaguacuccgaggaggcgaagcucaaccgcgaggagaucgacggcgugaagcuggagagcacccggaucuaccagauccuggccaucuacuccaccgucgccucgagccucgugcugguggucucccugggggccaucucguucuggaugugcuccaacggcagccuccagugccgcaucugcaucuga

SEQ ID NO: 9824 - RNA, 1701 nt, Artificial Sequence
  derived and/or modified CDS sequence (AUadapt) from InfluenzaA__AFN19865__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccuggugcacgacugcaacacgaccugccagacccccaagggcgccaucaacaccucgcugccguuccagaacauccaccccaucaccaucgggaagugccccaaguacgugaaguccaccaagcuccggcuggcgacgggccugcgcaacguccccagcauccagucccggggccucuucggggccaucgccggguucaucgagggcggcuggaccgggaugguggacggcugguacggguaccaccaccagaacgagcagggcucgggguacgccgccgaccugaaguccacccagaacgcgaucgacaagaucaccaacaaggugaacagcgucaucgagaagaugaacacgcaguucaccgccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagucggugaagaacgggaccuacgacuacccgaaguacuccgaggaggccaagcucaaccgggaggagaucgacggcgugaagcuggagagcacccgcaucuaccagauccuggcgaucuacuccaccgucgccucgucccucgugcugguggucagccugggggccaucucguucuggaugugcuccaacggcagccuccagugccggaucugcaucuga

SEQ ID NO: 9825 - RNA, 1701 nt, Artificial Sequence
  derived and/or modified CDS sequence (AUadapt) from InfluenzaA__AFN19875__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgagaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggccaccggcaaccuccuggucccccgcuacgcguucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggccaccggccugcggaacgugccguccauccagagccgcgggcuguucggcgcgaucgccggguucaucgagggcggcuggacggggaugguggacggcugguacggguaccaccaccagaacgagcagggcuccggguacgccgccgaccucaagucgacccagaacgccaucgacaagaucaccaacaaggugaacuccgucaucgagaagaugaacacccaguucacggcggugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggccaucuacuccaccgucgcgucgagccucgugcugguggucucccugggggccaucucguucuggaugugcuccaacggcagccuccagugccgcaucugcaucuga

SEQ ID NO: 9826 - RNA, 1701 nt, Artificial Sequence
  derived and/or modified CDS sequence (AUadapt) from InfluenzaA__AFN19895__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagaucuccaagucguacaucaacgacaagggcaaggaggugcugguccugugggggauccaccaccccagcaccacggccgaccagcagucccucuaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccgggucgggcaucaucaucuccgacacccccgugcacgacugcaacaccacgugccagaccccgaagggcgccaucaacaccagccuccccuuccagaacauccaccccaucaccaucgggcggugccccaaguacgugaaguccacgaagcugcgccuggccaccggccuccggaacgucccgucgauccagucccgcgggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacucggucaucgagaagaugaacacccaguucaccgcggugggcaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggaaccagcucaagaacaacgccaaggagaccgggaacggcugcuucgaguucuaccacaagugcgacaacacgugcauggagucggugaagaacgggaccuacgacuaccccaaguacuccgaggaggccaagcugaaccgcgaggugaucgacggcgucaagcuggagagcacccggaucuaccagauccucgccaucuacuccaccguggcgucgucccuggugcuggucgugagccucggggccaucucguucuggaugugcuccaacggcagccugcagugccgcaucugcaucuga

SEQ ID NO: 9827 - RNA, 1701 nt, Artificial Sequence
  derived and/or modified CDS sequence (AUadapt) from InfluenzaA__AFN19905__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccguggacaagaucacgaacaaggucaacuccgugaucgagaagaugaacacccaguucaccgcggucggcaaggaguucaaccaccuggagaagcgcaucgagaaccugaacaagaagguggacgacggguuccucgacaucuggaccuacaacgccgagcugcuggugcuccuggagaacgagcggacgcuggacuaccacgacagcaacgucaagaaccucuacgagaaggugcgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggagaagaucgacggggucaagcucgaguccacccgcaucuaccagauccuggccaucuacucgaccguggcguccagccuggugcucaucgucucccugggcgccaucucguucuggaugugcagcaacggcucccugcagugccggaucugcaucuga

SEQ ID NO: 9828 - RNA, 1701 nt, Artificial Sequence
  derived and/or modified CDS sequence (AUadapt) from InfluenzaA__AFN19915__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcaggccggcgcgaaguccuucuacaagaaccugaucuggcucgugaagaaggggaacagcuaccccaagcuguccucgagcuacaucaacgacaagggcaaggaggugcugguccucugggggauccaccaccccuccaccucggccgaccagcagucccuguaccagaacgccgacgccuacguguucgugggcacgagcgaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgucgauccagucccgcggccucuucggggccaucgccggguucaucgagggcggcuggacggggaugguggacggcugguacggguaccaccaccagaacgcccagggcagcggguacgccgcggaccugaaguccacccagaacgccaucgacaagaucaccaacaaggugaacucggucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggcgaagcucaaccgcgaggagaucgacggcgugaagcuggaguccacccggaucuaccagauccuggccaucuacagcaccgucgccucgucccucgugcugguggucagccugggggccaucuccuucuggaugugcagcaacggcucccuccagugccgcaucugcaucuga

SEQ ID NO: 9829 - RNA, 1701 nt, Artificial Sequence
  derived and/or modified CDS sequence (AUadapt) from InfluenzaA__AFN19922__HA
augaaggccauccugguggucgugcucuacaccuucgccaccgcgaacgccgacacgcugugcaucggcuaccacgccaacaacucgaccgacaccguggacaccguccuggagaagaacgugacggugacccacuccgucaaccuccuggaggacaagcacaacgggaagcugugcaagcuccgcggcguggcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgucucguccuucgagcgcuucgagaucuuccccaagaccucguccuggcccaaccacgacagcaacaagggggugaccgccgccugcccgcacgccggcgcgaagggguucuacaagaaccugaucuggcuggugaagaagggcaacuccuaccccaagcucucgcgguccuacaucaacgacaaggggaaggagguccuggugcuguggggcauccaccaccccucgaccacggccgaccagcagagccucuaccagaacgccgacaccuacguguucgucggcaccucccgcuacucgaagaaguucaagcccgagaucgccauccggccgaaggugcgcgaccaggaggggcggaugaacuacuacuggacccugguggagcccggcgacaagaucacguucgaggccaccgggaaccuggucgugccccgcuacgcguucgccauggagcggaacgccggcuccggcaucaucaucucggacacccccgcccaggacugcaacaccacgugccagaccccgaagggggccaucaacaccucccuccccuuccagaacauccaccccaucaccaucggcaagugccccaaguacgucaagagcacgaagcugcgccuggcgaccgggcuccggaacgugccguccauccagucgcgcggccuguucggggccaucgccggcuucaucgagggcggguggaccggcaugguggacgggugguacggcuaccaccaccagaacgagcagggguccggcuacgccgccgaccucaagucgacccagaacgcgaucgacaagaucacgaacaaggugaacuccgucaucgagaagaugaacacccaguucaccgccgugggcaaggaguucaaccaccuggagaagcggaucgagaaccugaacaagaaggucgacgacggguuccuggacaucuggaccuacaacgccgagcuccuggugcugcucgagaacgagcgcacgcuggacuaccacgacagcaacgugaagaaccuguacgagaagguccggaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcuggaguccacccggaucuaccagauccucgcgaucuacucgaccgucgccuccagccuggugcugguggucucccucggcgccaucucguucuggaugugcagcaacggcucccugcagugccgcaucugcaucuga

SEQ ID NO: 9830 - RNA, 1701 nt, Artificial Sequence; identical to SEQ ID NO: 6699
  derived and/or modified CDS sequence (AUadapt) from InfluenzaA__AFN19931__HA

SEQ ID NO: 9831 - RNA, 1701 nt, Artificial Sequence
  derived and/or modified CDS sequence (AUadapt) from InfluenzaA__AFN19941__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccaucucggacaacggcacgugcuaccccggcgacuucaucaacuacgaggagcuccgggagcagcuguccagcguguccucguucgagcgcuucgagaucuuccccaagaccuccagcuggcccaaccacgacuccaacaagggggucaccgccgccugcccgcaggccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacgcccagggcucgggguacgccgcggaccugaaguccacccagaacgccaucgacaagaucaccaacaaggugaacagcgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggcgaagcucaaccgcgaggagaucgacggcgugaagcuggaguccacccggaucuaccagauccuggccaucuacucgaccgucgccuccagccucgugcugguggucucgcugggggccaucuccuucuggaugugcagcaacggcucccuccagugccgcaucugcaucuga

SEQ ID NO: 9832 - RNA, 1701 nt, Artificial Sequence
  derived and/or modified CDS sequence (AUadapt) from InfluenzaA__AFN19951__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagucguacaucaacgacaagggcaaggaggugcugguccucugggggauccaccaccccagcaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagucgacccgcaucuaccagauccuggccaucuacuccaccgcggccagcucccugguccucguggugucgcugggggccaucucguucuggaugugcuccaacggcagccugcagugccggaucugcaucuga

SEQ ID NO: 9833 - RNA, 1701 nt, Artificial Sequence; identical to SEQ ID NO: 7060
  derived and/or modified CDS sequence (AUadapt) from InfluenzaA__AFN19966__HA

SEQ ID NO: 9834 - RNA, 1701 nt, Artificial Sequence
  derived and/or modified CDS sequence (AUadapt) from InfluenzaA__AFN19972__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacaacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcgucuaccagauccuggccaucuacuccaccguggcgucgucccuggugcucgucgugagccugggggccaucucguucuggaugugcuccaacggcagccugcagugccggaucugcaucuga

SEQ ID NO: 9835 - RNA, 1701 nt, Artificial Sequence
  derived and/or modified CDS sequence (AUadapt) from InfluenzaA__AFN19978__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccagcaccacggccgaccagcagucgcucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggagaagaucgacggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 9836 - RNA, 1701 nt, Artificial Sequence; identical to SEQ ID NO: 7060
  derived and/or modified CDS sequence (AUadapt) from InfluenzaA__AFN19983__HA

SEQ ID NO: 9837 - RNA, 1701 nt, Artificial Sequence
  derived and/or modified CDS sequence (AUadapt) from InfluenzaA__AFN19993__HA
augaaggccauccuggugguccuccuguacaccguggccaccacgaacgcggacacccugugcaucggcuaccacgccaacaacucgaccgacaccguggacacgguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagacguccucguccgacaacgggaccugcuaccccggcgacuucaucgacuacgaggagcuccgggagcagcugagcuccgucucguccuucgagcgcuucgagaucuuccccaagaccucguccuggcccaaccacgacagcaacaagggcgugaccgccgccugcccgcacgccggcgccaagggguucuacaagaaccugaucuggcucgugaagaagggcaacuccuaccccaagcugucgaaguccuacaucaacgacaaggggaaggagguccuggugcucuggggcauccaccaccccucgacgaccgcggaccagcagagccuguaccagaacgccgacaccuacguguucgucggcaccucccgguacucgaagaaguucaagcccgagaucgccauccgcccgaaggugcgggaccaggaggggcgcaugaacuacuacuggacgcugguggagcccggcgacaagaucaccuucgaggccaccgggaaccucgucgugccccgguacgccuucgcgauggagcgcaacgccggcuccggcaucaucaucucggacacccccgugcacgacugcaacacgaccugccagaccccgaagggggccaucaacaccucccugcccuuccagaacauccaccccaucacgaucggcaagugccccaaguacgucaagagcaccaagcugcggcucgccaccgggcugcgcaacgugccguccauccagucgcggggccuguucggggccaucgcgggcuucaucgagggcggguggaccggcaugguggacgggugguacggcuaccaccaccagaacgagcagggguccggcuacgccgccgaccucaagucgacgcagaacgccaucgacaagaucaccaacaaggucaacuccgugaucgagaagaugaacacccaguucaccgccgucggcaaggaguucaaccaccuggagaagcgcaucgagaaccugaacaagaagguggacgacggguuccucgacaucuggacguacaacgcggagcugcuggugcuccuggagaacgagcggacccuggacuaccacgacagcaacgucaagaaccucuacgagaaggugcgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggucaagcucgaguccacccgcaucuaccagauccuggccaucuacucgaccguggccuccagccuggugcucgucgugucccugggcgcgaucucguucuggaugugcagcaacggcucccugcagugccggaucugcaucuga

SEQ ID NO: 9838 - RNA, 1701 nt, Artificial Sequence; identical to SEQ ID NO: 7060
  derived and/or modified CDS sequence (AUadapt) from InfluenzaA__AFN20000__HA

SEQ ID NO: 9839 - RNA, 1701 nt, Artificial Sequence; identical to SEQ ID NO: 7067
  derived and/or modified CDS sequence (AUadapt) from InfluenzaA__AFN20006__HA

SEQ ID NO: 9840 - RNA, 1701 nt, Artificial Sequence; identical to SEQ ID NO: 6699
  derived and/or modified CDS sequence (AUadapt) from InfluenzaA__AFN20012__HA

SEQ ID NO: 9841 - RNA, 1701 nt, Artificial Sequence
  derived and/or modified CDS sequence (AUadapt) from InfluenzaA__AFN20018__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcaggccggcgcgaaguccuucuacaagaaccugaucuggcucgugaagaaggggaacucguaccccaagcuguccaacagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagucgacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgcgaggagaucgacggcgugaagcuggagagcacccggaucuaccagauccuggccaucuacuccaccgucgccucgagccucgugcugguggucucccugggggccaucucguucuggaugugcuccaacggcagccuccagugccgcaucugcaucuga

SEQ ID NO: 9842 - RNA, 1701 nt, Artificial Sequence; identical to SEQ ID NO: 7069
  derived and/or modified CDS sequence (AUadapt) from InfluenzaA__AFN20019__HA

SEQ ID NO: 9843 - RNA, 1701 nt, Artificial Sequence; identical to SEQ ID NO: 6699
  derived and/or modified CDS sequence (AUadapt) from InfluenzaA__AFN20021__HA

SEQ ID NO: 9844 - RNA, 1701 nt, Artificial Sequence; identical to SEQ ID NO: 7069
  derived and/or modified CDS sequence (AUadapt) from InfluenzaA__AFN20034__HA

SEQ ID NO: 9845 - RNA, 1701 nt, Artificial Sequence; identical to SEQ ID NO: 7060
  derived and/or modified CDS sequence (AUadapt) from InfluenzaA__AFN20040__HA

SEQ ID NO: 9846 - RNA, 1701 nt, Artificial Sequence; identical to SEQ ID NO: 9832
  derived and/or modified CDS sequence (AUadapt) from InfluenzaA__AFN20046__HA

SEQ ID NO: 9847 - RNA, 1701 nt, Artificial Sequence; identical to SEQ ID NO: 7069
  derived and/or modified CDS sequence (AUadapt) from InfluenzaA__AFN20052__HA

SEQ ID NO: 9848 - RNA, 1701 nt, Artificial Sequence; identical to SEQ ID NO: 7069
  derived and/or modified CDS sequence (AUadapt) from InfluenzaA__AFN20061__HA

SEQ ID NO: 9849 - RNA, 1701 nt, Artificial Sequence
  derived and/or modified CDS sequence (AUadapt) from InfluenzaA__AFN20076__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggacugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 9850 - RNA, 1701 nt, Artificial Sequence
  derived and/or modified CDS sequence (AUadapt) from InfluenzaA__AFN20081__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagaucuccaagucguacaucaacgacaagggcaaggaggugcugguccugugggggauccaccaccccagcaccacggccgaccagcagucccucuaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccuggugaucccccgguacgcguucgccauggagcgcaacgccgggucgggcaucaucaucuccgacacccccguccacgacugcaacaccacgugccagaccccgaagggcgccaucaacaccagccuccccuuccagaacauccaccccaucaccaucgggcggugccccaaguacgugaaguccacgaagcugcgccuggccaccggccuccggaacgugccgucgauccagucccgcgggcuguucggcgcgaucgccggguucaucgagggcggcuggaccgggauggucgacggcugguacggguaccaccaccagaacgagcagggcagcggguacgccgccgaccugaaguccacccagaacgccaucgacaagaucacgaacaaggugaacucggugaucgagaagaugaacacccaguucaccgcggucggcaaggaguucaaccaccucgagaagcggaucgagaaccugaacaagaagguggacgacggcuuccuggacaucuggaccuacaacgccgagcuccugguccugcucgagaacgagcgcacgcuggacuaccacgacuccaacgugaagaaccuguacgagaaggugcggaaccagcucaagaacaacgccaaggagaccgggaacggcugcuucgaguucuaccacaagugcgacaacacgugcauggagucggucaagaacgggaccuacgacuaccccaaguacuccgaggaggccaagcugaaccgcgaggugaucgacggcgugaagcuggagagcacccggaucuaccagauccucgccaucuacuccaccgucgcgucgucccuggugcugguggucagccucggggccaucucguucuggaugugcuccaacggcagccugcagugccgcaucugcaucuga

SEQ ID NO: 9851 - RNA, 1701 nt, Artificial Sequence; identical to SEQ ID NO: 7069
  derived and/or modified CDS sequence (AUadapt) from InfluenzaA__AFN20092__HA

SEQ ID NO: 9852 - RNA, 1701 nt, Artificial Sequence; identical to SEQ ID NO: 9831
  derived and/or modified CDS sequence (AUadapt) from InfluenzaA__AFN20099__HA

SEQ ID NO: 9853 - RNA, 1701 nt, Artificial Sequence
  derived and/or modified CDS sequence (AUadapt) from InfluenzaA__AFN20112__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcaagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacaacccgaacaagggggucaccgccgccugcccccacgccggcgccaagagcuucuacaagaaccugaucuggcucgugaagaacgggaacuccuaccccaagcugaacaccucguacaucaacgacaagggcaaggaggugcugguccucugggggauccaccaccccuccacgagcgccgaccagcagucgcuguaccagaacgccgacgccuacgccuucgugggcaccucccgguacucgaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucagcgacaccuccguccacgacugcaacacgaccugccagaccccgaagggcgcgaucaacaccucgcugcccuuccagaacgugcaccccaucaccaucgggaagugccccaaguacgugaaguccaccaagcugcggcucgccacgggccugcgcaacgucccgagcauccagucccgggggcuguucggcgccaucgccggguucaucgagggcggcuggaccgggaugguggacggcugguacggguaccaccaccagaacgagcagggcucgggguacgccgcggaccucaaguccacccagaacgccuucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagacgaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacucgaccgucgccuccagccuggugcucguggucucgcugggggccaucuccuucuggaugugcagcaacggcucccugcagugccggaucugcaucuga

SEQ ID NO: 9854 - RNA, 1701 nt, Artificial Sequence
  derived and/or modified CDS sequence (AUadapt) from InfluenzaA__AFN87924__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaccuccuacaucaacgacaagcggaaggaggugcugguccucuggggcauccaccaccccagcacgucggccgaccagcagucccuguaccagaacgccgacgccuacgccuucguggggaccagccgcuacuccaagaaguucaagccggagaucgcgauccggcccaaggugcgcgaccaggagggccggaugaacuacuacuggacccuggucgagcccggcgacaagaucaccuucgaggccacggggaaccucguggugccccgcuacgccuucgccauggagcggaacgccggcucggggaucaucaucuccgacaccagcguccacgacugcaacacgaccugccagaccccgaagggcgcgaucaacaccucccugcccuuccagaacgugcaccccaucaccaucggcaagugccccaaguacgucaagucgaccaagcugcgccucgccacggggcugcggaacgugccguccauccagagccgcggccuguucggggccaucgccggcuucaucgagggcggguggaccggcaugguggacgggugguacggcuaccaccaccagaacgagcagggguccggcuacgccgcggaccucaagucgacccagaacgccuucgacaagaucaccaacaaggugaacuccgucaucgagaagaugaacacgcaguucaccgccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggcgaagcugaaccgcgaggagaucgacggggugaagcucgagagcacccggaucuaccagauccuggccaucuacuccaccgucgccucgagccuggugcucguggucucccugggcgccaucucguucuggaugugcuccaacgggagccugcagugccgcaucugcaucuga

SEQ ID NO: 9855 - RNA, 1701 nt, Artificial Sequence; identical to SEQ ID NO: 116
  derived and/or modified CDS sequence (AUadapt) from InfluenzaA__AFN87926__HA

SEQ ID NO: 9856 - RNA, 1701 nt, Artificial Sequence
  derived and/or modified CDS sequence (AUadapt) from InfluenzaA__AFN87927__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagcggaaggaggugcugguccucuggggcauccaccaccccucgaccuccgccgaccagcagagccuguaccagaacgccgacgccuacguguucguggggacgucccgcuacucgaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcggcacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaaccgggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9857 - RNA, 1701 nt, Artificial Sequence
  derived and/or modified CDS sequence (AUadapt) from InfluenzaA__AFN87928__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucgccgugucccugggggccaucucguucuggaugugcuccaacggcagccugcagugccgcaucugcaucuga

SEQ ID NO: 9858 - RNA, 1701 nt, Artificial Sequence; identical to SEQ ID NO: 4078
  derived and/or modified CDS sequence (AUadapt) from InfluenzaA__AFN87929__HA

SEQ ID NO: 9859 - RNA, 1701 nt, Artificial Sequence; identical to SEQ ID NO: 4078
  derived and/or modified CDS sequence (AUadapt) from InfluenzaA__AFN87930__HA

SEQ ID NO: 9860 - RNA, 1701 nt, Artificial Sequence
  derived and/or modified CDS sequence (AUadapt) from InfluenzaA__AFN87931__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggagaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagcaucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucacgauggagcgcaacgccggguccggcaucaucaucagcgacacccccgugcacgacugcaacacgaccugccagaccccgaagggcgccaucaacaccucccuccccuuccagaacauccaccccaucaccaucgggaagugccccaaguacgucaagucgaccaagcugcggcuggccacgggccuccgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgccaucuacuccaccgucgcgucgagccuggugcugguggucucccucggggccaucucguucuggaugugcuccaacggcagccugcagugccggaucugcaucuga

SEQ ID NO: 9861 - RNA, 1701 nt, Artificial Sequence
  derived and/or modified CDS sequence (AUadapt) from InfluenzaA__AFN87932__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 9862 - RNA, 1701 nt, Artificial Sequence; identical to SEQ ID NO: 4078
  derived and/or modified CDS sequence (AUadapt) from InfluenzaA__AFN87933__HA

SEQ ID NO: 9863 - RNA, 1701 nt, Artificial Sequence
  derived and/or modified CDS sequence (AUadapt) from InfluenzaA__AFN87934__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcagcuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccagcaccucggccgaccagcagucccucuaccagaacgccgacacguacguguucgugggcaccucgcgguacuccaagaaguucaagcccgagaucgccauccgcccgaagguccgggaccaggaggggcgcaugaacuacuacuggacccugguggagcccggcgacaagaucaccuucgaggccacggggaaccugguggucccccgguacgcguucgccauggagcgcaacgccggcagcggcaucaucaucuccgacacccccgugcacgacugcaacacgaccugccagaccccgaagggggccaucaacaccucgcuccccuuccagaacauccaccccaucaccaucggcaagugccccaaguacgugaaguccaccaagcugcggcuggccacggggcuccgcaacgucccgagcauccagucccggggccuguucggggcgaucgccggcuucaucgagggcggguggaccggcaugguggacgggugguacggcuaccaccaccagaacgagcaggggucgggcuacgccgccgaccugaaguccacccagaacgccaucgacaagaucaccaacaaggugaacagcgucaucgagaagaugaacacgcaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacucgaccgucgcguccagccuggugcugguggucucgcucggcgccaucuccuucuggaugugcagcaacggcucccugcagugccggaucugcaucuga

SEQ ID NO: 9864 - RNA, 1701 nt, Artificial Sequence
  derived and/or modified CDS sequence (AUadapt) from InfluenzaA__AFN87936__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccaucucggacaacggcacgugcuaccccggcgacuucaucgacuacgaggagcuccgggagcagcuguccagcguguccucguucgagcgcuucgagaucuuccccaagaccuccagcuggcccaaccacgacccgaacaagggggucaccgccgccugcccccacgccggcgcgaaguccuucuacaagaaccugaucuggcucgugaagaaggggaacucguaccccaagcuguccaccagcuacaucaacgacaagggcaaggaggugcugguccucugggggauccaccaccccuccacgucggccgaccagcagagccuguaccagaacgccgacgccuacgccuucgugggcaccucccgguacagcaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucucggacaccuccguccacgacugcaacacgaccugccagaccccgaagggcgcgaucaacaccagccugcccuuccagaacgugcaccccaucaccaucgggaagugccccaaguacgugaaguccaccaagcugcggcucgccacgggccugcgcaucgucccgucgauccagucccgggggcuguucggcgccaucgccggguucaucgagggcggcuggaccgggaugguggacggcugguacggguaccaccaccagaacgagcagggcagcggguacgccgcggaccucaaguccacccagaacgccuucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggcgaagcugaaccgggaggagaucgacggcgugaagcucgaguccacccgcaucuaccagauccuggccaucuacagcaccgucgccuccucgcuggugcucguggucagccugggggccaucuccuucuggaugugcagcaacggcucccugcagugccggaucugcaucuga

SEQ ID NO: 9865 - RNA, 1701 nt, Artificial Sequence
  derived and/or modified CDS sequence (AUadapt) from InfluenzaA__AFN87938__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagaccucgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 9866 - RNA, 1701 nt, Artificial Sequence
  derived and/or modified CDS sequence (AUadapt) from InfluenzaA__AFN87939__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagucguucuacaagaaccugaucuggcucgugaagaaggggaacuccuaccccaagcugagcaccuccuacaucaacgacaagggcaaggaggugcugguccucugggggauccaccaccccucgacgagcgccgaccagcagucccuguaccagaacgccgacgccuacgccuucgugggcaccucgcgguacuccaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccgggagcggcaucaucaucuccgacaccucgguccacgacugcaacacgaccugccagaccccgaagggcgcgaucaacaccucccugcccuuccagaacgugcaccccaucaccaucgggaagugccccaaguacgucaagagcaccaagcugcggcucgccacgggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagucgacccagaacgccaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 9867 - RNA, 1701 nt, Artificial Sequence
  derived and/or modified CDS sequence (AUadapt) from InfluenzaA__AFN87941__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 9868 - RNA, 1701 nt, Artificial Sequence
  derived and/or modified CDS sequence (AUadapt) from InfluenzaA__AFN87943__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccaucagcgacaacggcacgugcuaccccggcgacuucaucgacuacgaggagcuccgggagcagcuguccucgguguccagcuucgagcgcuucgagaucuuccccaagaccuccucguggcccaaccacgacccgaacaagggggucaccgccgccugcccccacgccggcgcgaaguccuucuacaagaaccugaucuggcucgugaagaaggggaacagcuaccccaagcuguccaccucguacaucaacgacaagggcaaggaggugcugguccucugggggauccaccaccccuccacgagcgccgaccagcagucgcuguaccagaacgccgacgccuacgccuucgugggcaccucccgguacucgaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucagcgacaccuccguccacgacugcaacacgaccugccagaccccgaagggcgcgaucaacaccucgcugcccuuccagaacgugcaccccaucaccaucgggaagugccccaaguacgugaaguccaccaagcugcggcucgccacgggccugcgcaacgucccgagcauccagucccgggggcuguucggcgccaucgccggguucaucgagggcggcuggaccgggaugguggacggcugguacggguaccaccaccagaacgagcagggcucgggguacgccgcggaccucaaguccacccagaacgccaucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacucgaccgucgccuccagccuggugcucguggucucgcugggggccaucuccuucuggaugugcagcaacggcucccugcagugccggaucugcaucuga

SEQ ID NO: 9869 - RNA, 1701 nt, Artificial Sequence
  derived and/or modified CDS sequence (AUadapt) from InfluenzaA__AFN87945__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9870 - RNA, 1701 nt, Artificial Sequence
  derived and/or modified CDS sequence (AUadapt) from InfluenzaA__AFN87947__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaccuccuacaucaacgacaagggcaaggaggugcugguccucugggggauccaccaccccagcacgucggccgaccagcagucccuguaccagaacgccgacgccuacgccuucgugggcaccagccgguacuccaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccgggucgggcaucaucaucuccgacaccagcguccacgacugcaacacgaccugccagaccccgaagggcgcgaucaacaccucccugcccuuccagaacgugcaccccaucaccaucgggaagugccccaaguacgucaagucgaccaagcugcggcucgccacgggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacccagaacgccuucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 9871 - RNA, 1701 nt, Artificial Sequence
  derived and/or modified CDS sequence (AUadapt) from InfluenzaA__AFN87949__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccagcaccucggccgaccagcagucccucuaccagaacgccgacacguacguguucgugggcaccucgcgguacuccaagaaguucaagcccgagaucgccauccgcccgaagguccgggaccaggaggggcgcaugaacuacuacuggacccugguggagcccggcgacaagaucaccuucgaggccacggggaaccugguggucccccgguacgcguucgccauggagcgcaacgccggcagcggcaucaucaucuccgacacccccgugcacgacugcaacacgaccugccagaccccgaagggggccaucaacaccucgcuccccuuccagaacauccaccccaucaccaucggcaagugccccaaguacgugaaguccaccaagcugcggcuggccacggggcuccgcaacgucccgagcauccagucccggggccuguucggggcgaucgccggcuucaucgagggcggguggaccggcaugguggacgggugguacggcuaccaccaccagaacgagcaggggucgggcuacgccgccgaccugaaguccacccagaacgccaucgacaagaucaccaacaaggugaacagcgucaucgagaagaugaacacgcaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacucgaccgucgcguccagccuggugcugguggucucgcucggcgccaucuccuucuggaugugcagcaacggcucccugcagugccggaucugcaucuga

SEQ ID NO: 9872 - RNA, 1701 nt, Artificial Sequence; identical to SEQ ID NO: 7185
  derived and/or modified CDS sequence (AUadapt) from InfluenzaA__AFN87951__HA

SEQ ID NO: 9873 - RNA, 1701 nt, Artificial Sequence
  derived and/or modified CDS sequence (AUadapt) from InfluenzaA__AFN87953__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgaccugaacaagggggugaccgccgccugcccgcacgcgggcgccaagagcuucuacaagaaccucaucuggcuggucaagaaggggaacuccuaccccaagcugucgaaguccuacaucaacgacaagggcaaggaggugcucgugcugugggggauccaccaccccagcaccucggccgaccagcagucccuguaccagaacgccgacgccuacgucuucgugggcacgucgcgguacuccaagaaguucaagcccgagaucgcgauccgcccgaaggugcgggaccaggagggccgcaugaacuacuacuggacccucgucgagcccggggacaagaucaccuucgaggccaccggcaaccugguggugccccgguacgccuucgccauggagcgcaacgccgggagcggcaucaucaucuccgacacgcccguccacgacugcaacacgaccugccagaccccgaagggcgcgaucaacaccucgcugcccuuccagaacauccaccccaucaccaucgggaagugccccaaguacgugaaguccaccaagcuccggcuggccaccggccugcgcaacgugccgagcauccagucccggggccucuucggggccaucgccggguucaucgagggcggcuggacggggauggucgacggcugguacggguaccaccaccagaacgagcagggcucgggguacgccgcggaccugaaguccacccagaacgccaucgacgagaucaccaacaaggugaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggcgaagcucaaccgggaggagaucgacggcgugaagcuggaguccacccgcaucuaccagauccuggccaucuacucgaccguggccuccagccucguccugguggugucgcugggggccaucuccuucuggaugugcagcaacggcucccuccagugccggaucugcaucuga

SEQ ID NO: 9874 - RNA, 1701 nt, Artificial Sequence
  derived and/or modified CDS sequence (AUadapt) from InfluenzaA__AFN87955__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccucgaccacggccgaccagcagagccucuaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagucgcggggccuguucggggcgaucgccggcuucaucgagggcggguggaccggcaugguggacgggugguacggcuaccaccaccagaacgagcagggguccggcuacgccgccgaccucaagagcacccagaacgccaucgacgagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacucgaacgugaagaaccuguacgagaagguccgcucccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcuggagagcacccgcaucuaccagauccucgccaucuacuccaccgucgcgucgucccuggugcugguggucagccucggcgccaucucguucuggaugugcuccaacggcagccugcagugccggaucugcaucuga

SEQ ID NO: 9875 - RNA, 1701 nt, Artificial Sequence
  derived and/or modified CDS sequence (AUadapt) from InfluenzaA__AFN87957__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccaucucggacaacggcacgugcuaccccggcgacuucaucgacuacgaggagcuccgggagcagcuguccagcguguccucguucgagcgcuucgagaucuuccccaagaccuccagcuggcccaaccacgacccgaacaagggggucaccgccgccugcccccacgccggcgcgaaguccuucuacaagaaccugaucuggcucgugaagaaggggaacucguaccccaagcuguccaccagcuacaucaacgacaagggcaaggaggugcugguccucugggggauccaccaccccuccacgucggccgaccagcagagccuguaccagaacgccgacgccuacgccuucgugggcaccucccgguacucgaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucagcgacaccuccguccacgacugcaacacgaccugccagaccccgaagggcgcgaucaacaccucgcugcccuuccagaacgugcaccccaucaccaucgggaagugccccaaguacgugaaguccaccaagcugcggcucgccacgggccugcgcaacgucccgagcauccagucccgggggcuguucggcgccaucgccggguucaucgagggcggcuggaccgggaugguggacggcugguacggguaccaccaccagaacgagcagggcucgggguacgccgcggaccucaaguccacccagaacgccuucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacaagugcauggaguccgugaagaacgggacguacgacuaccccaaguacagcgaggaggcgaagcugaaccgggaggagaucgacggcgugaagcucgaguccacccgcaucuaccagauccuggccaucuacucgaccgucgccuccagccuggugcucguggucucgcugggggccaucuccuucuggaugugcagcaacggcucccugcagugccggaucugcaucuga

SEQ ID NO: 9876 - RNA, 1701 nt, Artificial Sequence
  derived and/or modified CDS sequence (AUadapt) from InfluenzaA__AFN87959__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccucgaccagcgccgaccagcagucccucuaccagaacgccgacacguacguguucgugggcaccucgcgguacuccaagaaguucaagcccgagaucgccauccgcccgaagguccgggaccaggaggggcgcaugaacuacuacuggacccugguggagcccggcgacaagaucaccuucgaggccacggggaaccugguggucccccgguacgcguucgccauggagcgcaacgccggcucgggcaucaucaucuccgacacccccgugcacgacugcaacacgaccugccagaccccgaagggggccaucaacaccagccuccccuuccagaacauccaccccaucaccaucggcaagugccccaaguacgugaaguccaccaagcugcggcuggccacggggcuccgcaacgucccgucgauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucaccaacaaggugaacucggucaucgagaagaugaacacgcaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcuggagagcacccgcaucuaccagauccucgccaucuacuccaccgucgcgucgucccuggugcugguggucagccucggcgccaucucguucuggaugugcuccaacggcagccugcagugccggaucugcaucuga

SEQ ID NO: 9877 - RNA, 1701 nt, Artificial Sequence; identical to SEQ ID NO: 3399
  derived and/or modified CDS sequence (AUadapt) from InfluenzaA__AFN87961__HA

SEQ ID NO: 9878 - RNA, 1698 nt, Artificial Sequence
  derived and/or modified CDS sequence (AUadapt) from InfluenzaA__AFO64802__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccucguggcccaaccacaccgugaccggggucuccgccagcugcucccacaacggcaagagcuccuucuaccgcaaccugcuguggcucaccgugaagaacgggcuguaccccaaccugagcaaguccuacgugaacaacaagggcaaggagguccucgugcuguggggcgugcaccaccccagcaacauccgggaccagcgcgccaucuaccacacggagaacgccuacgucagcgugguguccagccacuacucccggcgcuucaccccggagaucgccaagcggcccaagguccgcgaccaggaggggcggaucaacuacuacuggacccugcucgagcccggcgacaccaucaucuucgaggcgaacgggaaccugaucgcccccugguacgccuucgcccugucgcgcggcuucggguccggcaucaucacgagcaacgccccgauggacgagugcgacgcgaagugccagacgccccagggcgccaucaacuccagccuccccuuccagaacgugcaccccgugaccaucggggagugcccgaaguacguccgguccgccaagcugcgcauggugaccggccugcggaacauccccagcauccagucccgcggccucuucggggccaucgccggguucaucgagggcggcuggaccgggaugaucgacggcugguacggguaccaccaccagaacgagcagggcagcggguacgcggccgaccagaaguccacccagaacgccaucaacggcaucaccaacaaggugaacagcgucaucgagaagaugaacacccaguucacggccgugggcaaggaguucaacaagcuggagcggcgcauggagaaccugaacaagaaggucgacgacggguuccucgacaucuggaccuacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacaacgagugcauggaguccgugaagaacggcaccuacgacuaccccaaguacagcgaggaguccaagcugaaccgcgagaagaucgacggggugaagcucgagagcaugggcgucuaccagauccuggccaucuacagcacgguggccuccagccuggugcuccuggucucccugggcgccaucagcuucuggaugugcuccaacgggagccuccagugccggaucugcaucuga

SEQ ID NO: 9879 - RNA, 1701 nt, Artificial Sequence
  derived and/or modified CDS sequence (AUadapt) from InfluenzaA__AFO64813__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcguguccucguucgagcgcuucgagaucuuccccaaggaguccagcuggccgaaccacacggucaccaagggggugaccgccuccugcagccacaagggccgguccagcuucuaccgcaaccugcucuggcugaccgagaagaacggguccuaccccaaccugucgaagagcuacgugaacaacaaggagaaggagguccucgugcuguggggcgugcaccaccccuccaacauccgggaccagcgcgccaucuaccacacggagaacgcguacgucagcgugguguccucgcacuacaaccggcgcuucacccccgagaucgccaagcggccgaagguccgcgaccaggaggggcggaucaacuacuacuggacccugcucgagcccggcgacaccaucaucuucgaggccaacggcaaccugaucgcccccugguacgccuucgcgcugucccgcggguucggcagcgggaucaucacguccaacgccagcauggacgagugcgacgccaagugccagacgccccagggcgccaucaacuccucgcucccguuccagaacgugcaccccgugaccaucggcgagugccccaaguacguccgguccaccaagcugcgcauggugaccgggcugcggaacauccccagcauccagucccgcggccucuucggggccaucgcgggcuucaucgagggcggcuggaccggcaugaucgacgggugguacggcuaccaccaccagaacgagcaggggagcggcuacgccgccgaccagaaguccacccagaacgccaucaacgggaucaccaacaaggugaacagcgucaucgagaagaugaacacgcaguucaccgccgugggcaaggaguucaacaagcuggagcggcgcauggagaaccugaacaagaagguggacgacggcuuccucgacaucuggaccuacaacgcggagcugcugguccuccuggagaacgagcggacccuggacuuccacgacuccaacgugaagaaccucuacgagaaggucaagucgcagcugaagaacaacgccaaggagaucgggaacggcugcuucgaguucuaccacaagugcaacaacgagugcauggaguccgugaagaacgggacguacgacuacccgaaguacagcgaggagagcaagcugaaccgcgagaagaucgacggcgugaagcucgaguccaugggggucuaccagauccuggccaucuacucgaccguggccuccagccuggugcuccuggucucccugggcgccaucagcuucuggaugugcuccaacggcagccuccagugccggaucugcaucuga

SEQ ID NO: 9880 - RNA, 1701 nt, Artificial Sequence
  derived and/or modified CDS sequence (AUadapt) from InfluenzaA__AFO64824__HA
augaaggccauccugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcguguccagcuucgagcgcuucgagaucuuccccaaggaguccucguggccgaaccacacggucaccaagggcgugaccgccuccugcagccacaagggccgguccagcuucuaccgcaaccugcucuggcugaccgagaagaacgggcuguaccccaaccucuccaagagcuacgugaacaacaaggagaaggagguccuggugcuguggggcgugcaccaccccucgaacaucggggaccagcgggccaucuaccacacggagaacgcguacgucuccguggugagcucccacuacaaccgccgguucacccccgagaucgccaagcgcccgaagguccggggccaggagggccgcaucaacuacuacuggacccuccuggagcccggggacaccaucaucuucgaggccaacggcaaccugaucgcccccugguacgccuucgcgcucagccggggguucggcuccggcaucaucacgucgaacgccuccauggacgagugcgacgccaagugccagacgccccagggggccaucaacagcucccugccguuccagaacgugcaccccgugaccaucggcgagugccccaaguacguccgcagcaccaagcugaagauggugaccgggcuccggaacauccccuccauccagagccgcggccuguucggggccaucgcgggcuucaucgagggcggguggaccggcaugaucgacgggugguacggcuaccaccaccagaacgagcagggguccggcuacgccgccgaccagaaguccacccagaacgccaucaacggcaucaccaacaaggugaacucggucaucgagaagaugaacacgcaguucaccgccguggggaaggaguucaacaagcuggagaagcggauggagaaccucaacaagaagguggacgacggcuuccuggacaucuggaccuacaacgcggagcugcucguccugcuggagaacgagcgcacccucgacuuccacgacagcaacgugaagaaccuguacgagaaggucaagaaccagcugaagaacaacgccaaggagaucgggaacggcugcuucgaguucuaccacaagugcaacaacgagugcauggaguccgugaagaacgggacguacgacuacccgaaguacagcgaggaguccaagcucaaccgggagaagaucgacggcgugaagcuggagagcaugggcgucuaccagauccuggccaucuacucgaccguggccuccagccucgugcugcuggucucccucggggccaucagcuucuggaugugcuccaacggcagccugcagugccgcaucugcaucuga

SEQ ID NO: 9881 - RNA, 1701 nt, Artificial Sequence
  derived and/or modified CDS sequence (AUadapt) from InfluenzaA__AFO64835__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucuccaaggagucgugguccuacaucgccgagacccccgaccccgagaacgggaccugcuaccccggcuacuucgccgacuacgaggagcuccgggagcagcugagcuccgucagcuccuucgagcgcuucgagaucuucccgaaggagagcuccuggcccaaccacacggugaccaagggcgugaccgccucgugcucccacaacggcaagagcuccuucuaccggaaccugcucuggcugaccaagaagaacgggcuguaccccaaccucagcaaguccuacgucaacaacaaggagaaggaggugcuggugcuguggggcguccaccaccccagcaacaucggggagcagcgcgccaucuaccacacggagaacgcguacgugucgguggucuccagccacuacucccggcgcuucaccccggagaucgccaagcggcccaaggugcgcgaccaggagggccggaucaacuacuacuggacccuccuggagcccggcgacaccaucaucuucgaggccaacgggaaccugaucgcccccugguacgccuucgcgcucagccgcggcuucggguccggcaucaucacgucgaacgccuccauggacgagugcgacgccaagugccagaccccgcagggcgccaucaacagcucccugcccuuccagaacgugcaccccgucaccaucggggagugccccaaguacgugcggagcaccaagcugcgcauggugacgggccuccggaacaucccguccauccagagccgcgggcuguucggcgccaucgcgggguucaucgagggcggcuggaccgggaugaucgacggcugguacggguaccaccaccagaacgagcagggcuccggguacgccgccgaccagaaguccacccagaacgccaucaacggcaucaccaacaaggucaacucggugaucgagaagaugaacacgcaguucaccgccgugggcaaggaguucaacaagcuggagcggcgcauggagaaccucaacaagaaggucgacgacggguuccuggacaucuggaccuacaacgcggagcugcucgugcugcuggagaacgagcggacccucgacuuccacgacagcaacgucaagaaccuguacgagaaggugaagaaccagcugaagaacaacgccaaggagaucggcaacgggugcuucgaguucuaccacaagugcaacaacgagugcauggaguccgugaagaacggcacguacgacuaccccaaguacagcgaggaguccaagcucaaccgcgagaagaucgacggggucaagcuggagagcaugggcguguaccagauccuggccaucuacucgaccguggccuccagccucguccugcuggugucccucggcgccaucagcuucuggaugugcuccaacgggagccugcagugccggaucugcaucuga

SEQ ID NO: 9882 - RNA, 1701 nt, Artificial Sequence
  derived and/or modified CDS sequence (AUadapt) from InfluenzaA__AFO64846__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucaccaaggaguccuggucguacaucgccgagacccccaaccccgagaacggcacgugcuaccccggcuacuucgccgacuacgaggagcuccgggagcagcuguccagcgucuccagcuucgagcgcuucgagaucuucccgaaggaguccucguggcccaaccacaccgugaccaagggggugaccgccuccugcagccacaacggcaaguccagcuucuaccggaaccugcucuggcugacggagaagaacgggcuguaccccaaccucuccaagucguacgucaacaacaaggagaaggaggugcuggugcuguggggcguccaccaccccuccaacaugggggaccagcgcgccaucuaccacaccgagaacgcguacgugagcguggucagcucccacuacagccggcgcuucaccccggagaucgccaagcggcccaaggugcgcggccaggagggccggaucaacuacuacuggacccuccuggagcccggggacacgaucaucuucgaggccaacggcaaccugaucgcgccccgcuacgccuucgcccucucccggggguucggcucgggcaucaucaccuccaacgccagcauggacgagugcgacgccaagugccagaccccgcagggggccaucaacuccagccugcccuuccagaacgugcaccccgucaccaucggcgagugccccaaguacgugcgcuccacgaagcugcggauggugaccgggcuccgcaacaucccgucgauccagucccggggccuguucggggccaucgcgggcuucaucgagggcggguggaccggcaugaucgacgggugguacggcuaccaccaccagaacgagcaggggagcggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacuccaacgucaagaaccuguacgagaaggucaagucgcagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgugaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 9883 - RNA, 1701 nt, Artificial Sequence
  derived and/or modified CDS sequence (AUadapt) from InfluenzaA__AFO64857__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcggggccaggagggccgcaucaacuacuacuggacccuccuggagcccggggacacgaucaucuucgaggccaacggcaaccugaucgcccccugguacgccuucgcgcucucgcggggguucggcuccggcaucaucaccagcaccgccuccaugggggagugcgacgccaagugccagaccccgcagggcgccaucaacagcucccugcccuuccagaacgugcaccccgucacgaucggggagugccccaaguacgugcgcucgaccaagcugcggauggugaccggccuccgcaacaucccguccauccagagccgggggcuguucggcgccaucgcgggcuucaucgagggcggguggaccgggaugaucgacggcugguacggguaccaccaccagaacgagcagggcuccggcuacgccgccgaccagaaguccacgcagaacgccaucgacgggaucaccaacaaggucaacagcgugaucgagaagaugaacacccaguucaccgccgugggcaaggaguucaacaagcuggagcgccggauggagaaccucaacaagaaggucgacgacggguuccuggacaucuggacguacaacgcggagcugcucgugcugcuggagaacggccgcacccucgacuuccacgacucgaacgucaagaaccuguacgagaaggugaagaaccagcugaagaacaacgccaaggagaucgggaacggcugcuucgaguucuaccacaagugcaacaacgagugcauggaguccgugaagaacggcaccuacgacuaccccaaguacagcgaggaguccaagcucaaccgggagaagaucgacggggucaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 9884 - RNA, 1701 nt, Artificial Sequence
  derived and/or modified CDS sequence (AUadapt) from InfluenzaA__AFO64868__HA
augaaggugaagcugcucguccugcugugcgccuucaccgccaccuacgcggacacgaucugcaucggcuaccacgccaacaacucgaccgacaccguggacaccgugcucgagaagaacgucacggugacccacuccgugaaccugcuggaggacagccacaacgggaagcucugccgccugaagggcaccgcgccccugcagcucgggaacugcuccgucgccggcuggauccuggggaacccggagugcgagagccuguucuccaaggagucgugguccuacaucgccgagacccccaaccccgagaacggcacgugcuaccccggcugcuucgccgacuacgaggagcuccgggagcagcugagcuccgugagcuccuucgagcgcuucgagaucuucccgaaggagagcuccuggcccaaccacaccgugaccaagggggucaccgccucgugcucccacaacggcaagagcuccuucuacaagaaccugcucuggcugacggagaagaacgggcuguaccccaaccucagcaaguccuacgugaacaacaaggagaaggaggugcugguccuguggggcgugcaccaccccagcaacauccgggaccagcgcgccaucuaccacaccgagaacgccuacgugucggucguguccagccacuacucccggcgcuucaccccggagaucgcgaagcggcccaaggugcgcgggcaggagggccggaucaacuacuacuggacccuccuggagcccggcgacacgaucaucuucgaggccaacgggaaccugaucgcccccugguacgccuucgcccucagccgcggcuucggguccggcaucaucaccucgaacgcguccaugggcgagugcgacgccaagugccagaccccgcagggggccaucaacagcucccugcccuuccagaacguccaccccgugaccaucggcgagugccccaaguacgugcggagcacgaagcugcgcauggucaccgggcuccggaacaucccguccauccagagccgcggccuguucggggccaucgccggcuucaucgagggcggguggaccggcaugaucgacgggugguacggcuaccaccaccagaacgagcagggguccggcuacgcggccgaccagaaguccacccagaacgccaucgacggcaucacgaacaaggugaacucggugaucgagaagaugaacacccaguucaccgccgucgggaaggaguucaacaagcuggagcggcgcauggagaaccucaacaagaagguggacgacggcuuccuggacaucuggaccuacaacgccgagcugcucguccugcuggagaacgagcggacgcucgacuuccacgacagcaacgugaagaaccuguacgagaaggugaagaaccagcugaagaacaacgcgaaggagaucgggaacggcugcuucgaguucuaccacaagugcaacaacgagugcauggaguccgucaagaacgggaccuacgacuaccccaaguacagcgaggaguccaagcucaaccgcgagaagaucgacggcgugaagcuggagagcaugggcguguaccagauccuggccaucuacucgaccgucgccuccagccucgugcugcuggugucccucggggccaucagcuucuggaugugcuccaacggcagccugcagugccggaucugcaucuga

SEQ ID NO: 9885 - RNA, 1698 nt, Artificial Sequence
  derived and/or modified CDS sequence (AUadapt) from InfluenzaA__AFO64879__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuucaaggaguccuggagcuacaucgucgagacccccaaccccgagaacggcacgugcuaccccggcuacuucgccgacuacgaggagcugcgcgagcagcuguccagcguguccagcuucgagcgguucgagaucuucccgaaggaguccucguggcccaaccacaccgugaccggggucuccgccagcugcucccacaacggcaagagcuccuucuaccgcaaccuccuguggcugaccgagaagaacgggcucuaccccaaccugagcaaguccuacgugaacaacaaggagaaggaggugcugguccucuggggcgugcaccaccccagcaacauccgggaccagcgcgccaucuaccacacggagaacgccuacgugagcgucguguccagccacuacucccggcgcuucaccccggagaucgccaagcggcccaaggugcgcgggcaggagggccggaucaacuacuacuggacccugcuggagcccggcgacaccaucaucuucgaggcgaacgggaaccucaucgcccccugguacgccuucgcccugucgcgcggcuucggguccggcaucaucacgagcaacgccccgauggacgagugcgacgcgaagugccagacgccccagggcgccaucaacuccagccugcccuuccagaacguccaccccgugaccaucggggagugcccgaaguacgugcgguccgccaagcuccgcauggucaccggccugcggaacauccccagcauccagucccgcgggcuguucggcgccaucgccggguucaucgagggcggcuggaccgggaugaucgacggcugguacggguaccaccaccagaacgagcagggcagcggguacgcggccgaccagaaguccacccagaacgccaucaacggcaucaccaacaaggugaacagcgugaucgagaagaugaacacccaguucacggccgucggcaaggaguucaacaagcucgagcggcgcauggagaaccugaacaagaagguggacgacggguuccuggacaucuggaccuacaacgccgagcuccugguccugcucgagaacgagcggacccuggacuuccacgacuccaacgugaagaaccuguacgagaaggucaagucgcagcucaagaacaacgcgaaggagaucggcaacgggugcuucgaguucuaccacaagugcaacaacgagugcauggaguccgugaagaacggcaccuacgacuaccccaaguacagcgaggaguccaagcugaaccgcgagaagaucgacggggugaagcuggagagcaugggcguguaccagauccucgccaucuacagcacggucgccuccagccuggugcugcucgugucccugggcgccaucagcuucuggaugugcuccaacgggagccugcagugccggaucugcaucuga

SEQ ID NO: 9886 - RNA, 1698 nt, Artificial Sequence
  derived and/or modified CDS sequence (AUadapt) from InfluenzaA__AFO64890__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagucguccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacauccgggaccagcgcgccaucuaccacacggagaacgccuacguguccgucgugagcucccacuacucgcggcgcuucaccccggagaucgccaagcggcccaaggugcgcgggcaggagggccggaucaacuacuacuggacccugcuggagcccggcgacaccaucaucuucgaggcgaacgggaaccucaucgcccccugguacgccuucgcccugucccgcggcuucgggagcggcaucaucacguccaacgccccgauggacgagugcgacgucaagugccagacgccccagggcgcgaucaacagcucccugcccuuccagaacgugcaccccgugaccaucggggagugcccgaaguacguccggagcgccaagcuccgcauggugaccggccugcggaacauccccuccauccagagccgcgggcuguucggcgccaucgccggguucaucgagggcggcuggaccgggaugaucgacggcugguacggguaccaccaccagaacgagcagggcuccggguacgccgcggaccagaaguccacccagaacgccaucaacggcaucaccaacaaggugaacagcgucaucgagaagaugaacacccaguucacggccgugggcaaggaguucaacaagcucgagcggcgcauggagaaccugaacaagaaggucgacgacggguuccuggacaucuggaccuacaacgccgagcuccuggugcugcucgagaacgagcggacccuggacuuccacgacucgaacgugaagaaccuguacgagaaggucaagucccagcucaagaacaacgccaaggagaucggcaacgggugcuucgaguucuaccacaagugcaacaacgagugcauggagagcgugaagaacggcaccuacgacuaccccaaguacuccgaggagagcaagcugaaccgcgagaagaucgacggggugaagcuggagagcaugggcgucuaccagauccucgcgaucuacuccacgguggccagcucccuggugcugcucgucagccugggcgccaucuccuucuggaugugcagcaacgggucccugcagugccggaucugcaucuga

SEQ ID NO: 9887 - RNA, 1701 nt, Artificial Sequence
  derived and/or modified CDS sequence (AUadapt) from InfluenzaA__AFO64901__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgugagcuccuucgagcgcuucgagaucuucccgaaggagucguccuggcccaaccacaccgucaccaagggggugaccgccagcugcucccacaacggcaagagcuccuucuacaagaaccugcucuggcugacggagaagaacgggcuguaccccaaccucucgaaguccuacgugaacaacaagaagaaggagguccuggugcuguggggcgugcaccaccccagcaacaucggggaccagcgggccaucuaccacaccgagaacgcguacgucagcgugguguccagccacuacucccgccgguucaccccggagaucgccaagcgccccaagguccggaaccaggagggccgcaucaacuacuacuggacccuccuggagcccggcgacacgaucaucuucgaggccaacgggaaccugaucgcccccugguacgccuucgcgcucucgcggggcuucgaguccgggaucaucaccagcaacgccuccaugggcgagugcgacgccaagugccagaccccgcagggcgccaucaacagcucccugcccuuccagaacgugcaccccgugaccaucggggagugccccaaguacguccgcucgacgaagcugcggauggugaccggccuccgcaacaucccguccauccagagccgggggcuguucggcgccaucgcgggguucaucgagggcggcuggaccgggaugaucgacggcugguacggguaccaccaccagaacgagcagggcuccggguacgccgccgaccagaaguccacccagaacgccaucaacggcaucacgaacaaggugaacagcaucaucgagaagaugaacacccaguucaccgccgucggcaaggaguucaacaagcuggagcgccggauggagaaccucaacaagaagguggacgacggguuccuggacaucuggaccuacaacgcggagcugcucgugcugcuggagaacgagcgcacgcucgacuuccacgacucgaacgucaagaaccuguacgagaaggugaagaaccagcugaagaacaacgccaaggagaucggcaacgggugcuucgaguucuaccacaagugcaacaacgagugcauggaguccgucaagaacggcaccuacgacuaccccaaguacagcaaggaguccaagcucaaccgggagaagaucgacggggugaagcuggagagcaugggcguguaccagauccuggccaucuacucgaccgucgccuccagccucgugcugcuggugucccucggcgccaucagcuucuggaugugcuccaacgggagccugcagugccgcaucugcaucuga

SEQ ID NO: 9888 - RNA, 1698 nt, Artificial Sequence
  derived and/or modified CDS sequence (AUadapt) from InfluenzaA__AFO65016__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugucguccuucgagcgguucgagaucuucccgaaggagagcuccuggcccaaccacaccgugaccggggucagcgccuccugcagccacaacggcaaguccagcuucuaccgcaaccuccuguggcugaccaagaagaacgggcucuaccccaaccuguccaagucguacgugaacaacaaggagaaggaggugcugguccucuggggcgugcaccaccccagcaacaucggggaccagcggacgaucuaccacaccgagaacgccuacguguccgucgugagcucccacuacagccgccgguucaccccggagaucgccaagcgccccaaggugcgggaccaggagggccgcaucaacuacuacuggacccugcuggagcccggcgacacgaucaucuucgaggccaacgggaaccucaucgcgcccugguacgccuucgcccugucccggggcuucgggagcggcaucaucaccuccaacgccccgauggacgagugcgacgccaagugccagacgccccagggcgcgaucaacucgucccugcccuuccagaacguccaccccaucaccaucggggagugcccgaaguacgugcgcagcgccaagcuccggauggugaccggccugcgcaacauccccuccauccagagccgggggcuguucggcgccaucgccggguucaucgagggcggcuggaccgggaugaucgacggcugguacggguaccaccaccagaacgagcagggcuccggguacgccgcggaccagaaguccacccagaacgccaucaacggcaucaccaacaaggucaacagcgugaucgagaagaugaacacgcaguucaccgccgugggcaaggaguucaacaaccucgagcgccggauggagaaccugaacaagaaggucgacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcaacaacgagugcauggagucggugaagaacggcacguacgacuaccccaaguacuccgaggagagcaagcugaaccgggagaagaucgacggggucaagcuggagagcaugggcguguaccagauccucgcgaucuacuccaccguggccagcucccugguccugcucgugagccugggcgccaucuccuucuggaugugcagcaacgggucccugcagugccgcaucugcaucuga

SEQ ID NO: 9889 - RNA, 1698 nt, Artificial Sequence; identical to SEQ ID NO: 2360
  derived and/or modified CDS sequence (AUadapt) from InfluenzaA__AFO65027__HA

SEQ ID NO: 9890 - RNA, 1698 nt, Artificial Sequence
  derived and/or modified CDS sequence (AUadapt) from InfluenzaA__AFO65038__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccucguggcccaaccacaccgugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucgggaaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 9891 - RNA, 1698 nt, Artificial Sequence
  derived and/or modified CDS sequence (AUadapt) from InfluenzaA__AFO66136__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 9892 - RNA, 1701 nt, Artificial Sequence
  derived and/or modified CDS sequence (AUadapt) from InfluenzaA__AFO66147__HA
augaaggccaagcugcucgugcugcugugcgccuucaccaccacguacgcggacaccaucugcaucggcuaccacgccaacaacucgaccgacaccgucgacacggugcucgagaagaacgugaccgucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagucgugguccuacaucgccgagacgcccaaccccaagaacgggaccugcuaccccggcuacuucgccgacuacgaggagcuccgggagcagcugagcuccgugagcuccuucgagcgcuucgagaucuucccgaaggacagcuccuggcccaaccacaccgucaccaagggcgugacggccucgugcucccacaacggcaagagcuccuucuacaagaaccugcucuggcugaccgggaagaacggccuguaccccaaccucagcaaguccuacgugaacaagaaggggaaggagguccuggugcuguggggcgugcaccaccccagcaacaugggcgaccagcgggccaucuaccacaaggagaacgccuacgucucggugcucuccagccacuacucccgccgguucaccccggagaucgcgaagcgccccaaggugcgggaccaggaggggcgcaucaacuacuacuggacccugcuggagcccggcgacacgaucaucuucgaggccaacgggaaccucaucgcccccugguacgccuucgcccugagccggggcuucggcuccgggaucaucaucucgaacgcguccaugggcgagugcgacgccaagugccagaccccgcagggggccaucaacagcucccugcccuuccagaacguccaccccgugaccaucggcgagugccccaaguacgugcgcagcaccaagcuccggauggucacggggcugcgcaacgugccguccauccagagccggggccuguucggcgccaucgccggguucaucgagggcggguggaccggcaugaucgacgggugguacggcuaccaccaccagaacgagcagggcuccggguacgcggccgaccagaaguccacccagaacgccaucaacggcaucaccaacaaggugaacucgaucaucgagaagaugaacacgcaguucaccgccgucgggaaggaguucaacaagcucgagcgccggauggagaaccugaacaagaagguggacgacggcuuccuggacaucuggaccuacaacgccgagcuccuggugcugcucgagaacgagcgcacccuggacuuccacgacagcaacgucaagaaccuguacgagaaggugaagaaccagcucaagaacaacgcgaaggagaucgggaacggcugcuucgaguucuaccacaagugcaacaacgagugcauggaguccgucaagaacggcacguacgacuaccccaaguacagcaaggaguccaagcugaaccgggagaagaucgacggggugaagcuggagagcaugggcguguaccagauccucgccaucuacucgaccgucgccuccagccuggugcugcucgugucccugggggccaucagcuucuggaugugcuccaacggcagccugcagugccgcaucugcaucuga

SEQ ID NO: 9893 - RNA, 1698 nt, Artificial Sequence
  derived and/or modified CDS sequence (AUadapt) from InfluenzaA__AFO66158__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagggcuccuggagcuacaucgucgagacccccaaccccgagaacggcacgugcuaccccggguacuucgccgacuacgaggagcugcgcgagcagcucuccagcguguccagcuucgagcgguucgagaucuucccgaagggcuccucguggcccaaccacaccgugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucgggaaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggcuucgggagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccggggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacggcucccugcagugccgcaucugcaucuga

SEQ ID NO: 9894 - RNA, 1698 nt, Artificial Sequence
  derived and/or modified CDS sequence (AUadapt) from InfluenzaA__AFO66169__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaccuccaaccccgagaacggcacgugcuaccccggcuacuucaccgacuacgaggagcugcgcgagcagcucucguccgugagcuccuucgagcgguucgagaucuuccccaaggagagcuccuggccgaaccacaccgucaccggggugagcgccuccugcucgcacaacggcaaguccagcuucuacaagaaccugcuguggcucacggggaagaacggccuguaccccaaccuguccaagagcuacgccaacaacaaggagaaggaggugcucguccuguggggcgugcaccacccgcccaacaucggggaccagcgcgcccuguaccacaccgagaacgccuacgugagcgucguguccagccacuacucccggcgcuucacccccgagaucgccaagcggcccaaggugcgcgaccaggagggccggaucaacuacuacuggacccuccuggagcccggggacacgaucaucuucgaggccaacggcaaccugaucgcgccccgcuacgccuucgcccucucgcggggguucggcuccggcaucaucaccagcaacgccccgauggacgagugcgacgccaagugccagacgccccacggggcgaucaacuccagccugcccuuccagaacguccaccccgugaccaucggcgagugcccgaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggucgggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcugaaccgggagaagaucgacggcgugaagcucgagucgaugggcgucuaccagauccuggcgaucuacagcaccguggccuccagccuggugcuccuggucucccugggggccaucagcuucuggaugugcuccaacggcagccuccagugccgcaucugcaucuga

SEQ ID NO: 9895 - RNA, 1698 nt, Artificial Sequence
  derived and/or modified CDS sequence (AUadapt) from InfluenzaA__AFO66180__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcggaaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 9896 - RNA, 1698 nt, Artificial Sequence
  derived and/or modified CDS sequence (AUadapt) from InfluenzaA__AFO66191__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 9897 - RNA, 1698 nt, Artificial Sequence; identical to SEQ ID NO: 757
  derived and/or modified CDS sequence (AUadapt) from InfluenzaA__AFO66202__HA

SEQ ID NO: 9898 - RNA, 1698 nt, Artificial Sequence
  derived and/or modified CDS sequence (AUadapt) from InfluenzaA__AFO66213__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaagaagaaggaggugcucguccuguggggcgugcaccacccgcccaacaucgggaaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 9899 - RNA, 1698 nt, Artificial Sequence
  derived and/or modified CDS sequence (AUadapt) from InfluenzaA__AFO66224__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 9900 - RNA, 1698 nt, Artificial Sequence
  derived and/or modified CDS sequence (AUadapt) from InfluenzaA__AFO66235__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcaagucguccuucuacaagaaccugcuguggcucaccgggaagaacggccuguaccccaaccugagcaaguccuacgccaacaacaaggagaaggaggugcucguccuguggggcgugcaccacccgcccaacaucggcgugcagcgcgcccuguaccacaccgagaacgccuacgucagcguggugagcucccacuacucgcggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 9901 - RNA, 1698 nt, Artificial Sequence
  derived and/or modified CDS sequence (AUadapt) from InfluenzaA__AFO66246__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcaaccagcgcgcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcggagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 9902 - RNA, 1701 nt, Artificial Sequence
  derived and/or modified CDS sequence (AUadapt) from InfluenzaA__AFP33324__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagucgugguccuacaucgccgagacgcccaaccccaagaacgggaccugcuaccccggcuacuucgccgacuacgaggagcuccgggagcagcugagcuccgugagcuccuucgagcgcuucgagaucuucccgaaggacagcuccuggcccaaccacaccgucaccaagggcgugacggccucgugcucccacaacggcaagagcuccuucuacaagaaccugcucuggcugaccgggaagaacggccuguaccccaaccucagcaaguccuacgugaacaagaaggggaaggagguccuggugcuguggggcgugcaccaccccagcaacaugggcgaccagcgggccaucuaccacaaggagaacgccuacgucucggugcucuccagccacuacucccgccgguucaccccggagaucgcgaagcgccccaaggugcgggaccaggaggggcgcaucaacuacuacuggacccugcuggagcccggcgacacgaucaucuucgaggccaacgggaaccucaucgcccccugguacgccuucgcccugagccggggcuucggcuccgggaucaucaucucgaacgcguccaugggcgagugcgacgccaagugccagaccccgcagggggccaucaacagcucccugcccuuccagaacguccaccccgugaccaucggcgagugccccaaguacgugcgcagcaccaagcuccggauggucacggggcugcgcaacgugccguccauccagagccggggccuguucggcgccaucgccggguucaucgagggcggguggaccggcaugaucgacgggugguacggcuaccaccaccagaacgagcagggcuccggguacgcggccgaccagaaguccacccagaacgccaucaacggcaucaccaacaaggugaacucgaucaucgagaagaugaacacgcaguucaccgccgucgggaaggaguucaacaagcucgagcgccggauggagaaccugaacaagaagguggacgacggcuuccuggacaucuggaccuacaacgccgagcuccuggugcugcucgagaacgagcgcacccuggacuuccacgacagcaacgucaagaaccuguacgagaaggugaagacgcagcucaagaacaacgcgaaggagaucgggaacggcugcuucgaguucuaccacaagugcaacaacgagugcauggaguccgucaagaacggcaccuacgacuaccccaaguacagcaaggaguccaagcugaaccgggagaagaucgacggggugaagcuggagagcaugggcguguaccagauccucgccaucuacucgaccgucgccuccagccuggugcugcucgugucccugggggccaucagcuucuggaugugcuccaacggcagccugcagugccgcaucugcaucuga

SEQ ID NO: 9903 - RNA, 1698 nt, Artificial Sequence
  derived and/or modified CDS sequence (AUadapt) from InfluenzaA__AFP33325__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugauccccaaggagagcugguccuacaucguggagacccccaaccccgagaacggcacgugcuacccgggcuacuucgccgacuacgaggagcugcgcgagcagcucagcuccgugagcuccuucgagcgguucgagaucuuccccaaggagucguccuggcccagccacaccgucaccgggguguccgccagcugcucccacaacggcaagagcuccuucuaccgcaaccugcuguggcucaccgggaagaacggccuguaccccaaccugagcaaguccuacucgaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcggggccaggaggggcgcaucaacuacuacuggacccuccuggagccgggcgacaccaucaucuucgaggccaacgggaaccugaucgcgcccugguacgccuucgcccucagccggggcuucggcuccgggaucaucacgagcaacgcccccauggacgagugcgacgccaagugccagacgccccagggcgcgaucaacuccucgcugccguuccagaacguccaccccgugaccaucggggagugccccaaguacgugcgcuccgccaagcugcggauggucaccggccuccgcaacauccccagcauccagucccgggggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcaccuacgacuacccgaaguacucggaggaguccaagcucaaccgggagaagaucgacggcgugaagcuggagagcaugggggucuaccagauccuggcgaucuacagcacgguggccuccagccucgugcugcuggucucccucggcgccaucagcuucuggaugugcuccaacgggagccugcagugccgcaucugcaucuga

SEQ ID NO: 9904 - RNA, 1701 nt, Artificial Sequence
  derived and/or modified CDS sequence (AUadapt) from InfluenzaA__AFQ32573__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgugggggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcgcugcucggguucaucaugugggccugccagaagggcaacauccggugcaacaucugcaucuga

SEQ ID NO: 9905 - RNA, 1701 nt, Artificial Sequence
  derived and/or modified CDS sequence (AUadapt) from InfluenzaA__AFQ37281__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccucgacguccaccgaccagcagagccuguaccagaacgcggacgccuacguguucgugggcaccucccgguacucgaagaaguucaagcccgagaucgccauccgcccgaagguccgggaccgcgagggccggaugaacuacuacuggacccugguggagcccggggacaagaucacguucgaggccaccggcaaccucguggucccccgcuacgccuucgcgauggagcggaacgccggguccggcaucaucaucagcgacacccccgcccacgacugcaacaccacgugccagaccccgaagggcgccaucaacaccucccugcccuuccagaacgugcaccccaucaccaucgggaagugccccaaguacgucaagucgacgaagcugcgccucgccaccggccugcggaacgugccguccauccagucgcgcgggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacucgaacgugaagaaccucuacgagaagguccggucccagcugaagaacaacgccaaggagaucgggaacggcugcuucgaguucuaccacaagugcgacgacaagugcauggagagcgugaagaacgggaccuacgacuaccccaaguacuccgaggaggccaagcugaaccgcgaggagaucgacggcgugaagcucgagucgacccggaucuaccagauccuggccaucuacuccaccgcggccucgagccugguccucguggugucccugggggccaucucguucuggaugugcuccaacggcagccugcagugccgcaucugcaucuga

SEQ ID NO: 9906 - RNA, 1707 nt, Artificial Sequence
  derived and/or modified CDS sequence (AUadapt) from InfluenzaA__AFQ55689__HA
augaauacccaaauccuggcccucaucgccugcaugcugaucggcgcgaagggggacaagaucugccugggccaccacgccguggccaacgggaccaaggucaauacgcucaccgagcgcggcaucgagguggugaacgccaccgagaccgucgagacggccaacaccaagaagaucugcacccaggggaagcggcccaccgaccugggccagugcggccugcucgggacgcugaucggcccgccccagugcgaucaguuccuggaguucgacgcggaccucaucaucgagcgccgggaggggaccgacgugugcuaucccggcaaguucaccaacgaggagagccugcgccagauccugcggggguccggcggcaucgacaaggagagcaugggguucaccuauuccggcauccgcacgaacggggccaccagcgccugccggcgcuccggcagcuccuucuacgccgagaugaaguggcuccugaguaacuccgacaacgcggccuucccccagaugaccaagagcuaccggaauccgcgcaacaagcccgcccugaucaucuggggcgugcaccacuccgggagcgccaccgagcagacgaagcucuacggcuccgggaacaagcugaucaccgucggcaguuccaaguaccagcagagcuucacccccucccccggggcccggccccaggugaacggccagagcggccgcaucgacuuucacuggcugcuccuggacccgaacgacaccgugacguucaccuucaauggggcguucaucgcccccgaccgggccuccuucuuccgcggcgagagcaucgggguccagagcgaugugccccuggacuccggcugcgagggggacugcuuccacaauggcggcaccaucgugagcucccucccguuccagaacaucaacccccggaccgucgggaagugcccccgcuacgugaagcagacgagucugcugcucgccaccggcaugcggaacgugcccgaaaacccgaaggaccgcaagucccggcaccgccggacccgcgggcuguucggcgccaucgcgggguucaucgagaauggcugggagggccugaucgacgggugguacggcuuccgccaccagaacgcccagggggagggcaccgccgccgacuauaagagcacgcaguccgccaucgaccagaucaccggcaagcucaaccggcugaucgacaagaccaaccagcaguucgagcugaucgauaacgaguucagcgagaucgagcagcagaucgggaacgucaucaacuggacccgcgacuccaugacggagguguggaguuacaacgcggagcuccugguggccauggagaaccagcacaccaucgaccuggccgacuccgagaugaauaagcucuacgagcggguccgcaagcagcugcgggagaacgccgaggaggacggcaccgggugcuucgagaucuuccauaagugcgacgaccagugcauggagagcauccgcaacaauaccuacgaccacacgcaguaccgggccgagucccugcagaaccgcauccagaucgaccccgugaagcucaguuccggcuacaaggacaucauccugugguucagcuucggggcguccugcuuucugcuccuggccaucgccaugggccugguguucaucugcaucaagaacggcaacaugcggugcaccaucugcaucuga

SEQ ID NO: 9907 - RNA, 1701 nt, Artificial Sequence; identical to SEQ ID NO: 8431
  derived and/or modified CDS sequence (AUadapt) from InfluenzaA__AFR68153__HA

SEQ ID NO: 9908 - RNA, 1701 nt, Artificial Sequence
  derived and/or modified CDS sequence (AUadapt) from InfluenzaA__AFR68163__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgccaaccugcuggaggacaagcacaacgggaagcucugcaagcugcgcggcguggcgccccugcaccucgggaagugcaacaucgccggcuggauccuggggaacccggagugcgagacccugucgacggccuccucgugguccuacaucgucgagaccucguccagcgacaacgggaccugcuaccccggcgacuucaucgacuacgaggagcuccgggagcagcuguccucgguguccucguucgagcgcuucgagaucuuccccaagaccuccucguggcccaaccacgacuccaacaagggcgugacggccgccugcccgcacgcgggcgccaagggguucuacaagaaccugaucuggcucgucaagaagggcaacucguaccccaagcuguccaagagcuacaucaacgacaaggggaaggaggugcuggugcucuggggcauccaccaccccuccaccaccgccgaccagcagucgcuguaccagaacgccgacaccuacgucuucgugggcacgucgcgguacuccaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcgacgccggcucgggcaucaucaucuccgacacgcccguccacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgugccgucgauccagucccggggccuguucggggccaucgccggcuucaucgagggcggguggacgggcauggucgacgggugguacggcuaccaccaccagaacgagcaggggucgggcuacgccgccgaccucaaguccacccagaacgcgaucgacaagaucaccaacaaggugaacucggugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccgccgccucgucccuggugcucgucgugucgcugggcgccaucuccuucuggaugugcucgaacggcagccugcagugccggaucugcaucuga

SEQ ID NO: 9909 - RNA, 1701 nt, Artificial Sequence
  derived and/or modified CDS sequence (AUadapt) from InfluenzaA__AFR68173__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaguccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagaacacccugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 9910 - RNA, 1701 nt, Artificial Sequence; identical to SEQ ID NO: 116
  derived and/or modified CDS sequence (AUadapt) from InfluenzaA__AFR84675__HA

SEQ ID NO: 9911 - RNA, 1701 nt, Artificial Sequence; identical to SEQ ID NO: 3267
  derived and/or modified CDS sequence (AUadapt) from InfluenzaA__AFR84685__HA

SEQ ID NO: 9912 - RNA, 1701 nt, Artificial Sequence; identical to SEQ ID NO: 96
  derived and/or modified CDS sequence (AUadapt) from InfluenzaA__AFR84694__HA

SEQ ID NO: 9913 - RNA, 1701 nt, Artificial Sequence; identical to SEQ ID NO: 62
  derived and/or modified CDS sequence (AUadapt) from InfluenzaA__AFR84704__HA

SEQ ID NO: 9914 - RNA, 1701 nt, Artificial Sequence
  derived and/or modified CDS sequence (AUadapt) from InfluenzaA__AFR84714__HA
augaaggccauccuggugguccuccuguacaccuucgccaccgcgaacgccgacacgcugugcaucggcuaccgcgccaacaacucgaccgacaccguggacaccgugcucgagaagaacgucacggugacccacuccgugaacauccuggaggacaagcacaacgggaagcugugcaagcuccggggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgcgagcagcucagcuccgugucguccuucgagcgguucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccugguggucccccgcuacgccuucgccauggagcggaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcgccuggcgaccggccuccggaacgucccgucgauccagucccgcgggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcggaucgagaaccugaacaagaaggucgacgacggcuuccuggacaucuggacguacaacgccgagcuccuggugcugcucgagaacgagcgcacccuggacuaccacgacuccaacgugaagaaccuguacgagaagguccggagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcuggaguccacccggaucuaccagauccucgcgaucuacagcaccgucgccucgucccuggugcugguggucagccucggggccaucuccuucuggaugugcagcaacggcucccugcagugccgcaucugcaucuga

SEQ ID NO: 9915 - RNA, 1701 nt, Artificial Sequence; identical to SEQ ID NO: 96
  derived and/or modified CDS sequence (AUadapt) from InfluenzaA__AFR84724__HA

SEQ ID NO: 9916 - RNA, 1701 nt, Artificial Sequence; identical to SEQ ID NO: 96
  derived and/or modified CDS sequence (AUadapt) from InfluenzaA__AFR84734__HA

SEQ ID NO: 9917 - RNA, 1701 nt, Artificial Sequence; identical to SEQ ID NO: 96
  derived and/or modified CDS sequence (AUadapt) from InfluenzaA__AFR84754__HA

SEQ ID NO: 9918 - RNA, 1701 nt, Artificial Sequence; identical to SEQ ID NO: 96
  derived and/or modified CDS sequence (AUadapt) from InfluenzaA__AFR84764__HA

SEQ ID NO: 9919 - RNA, 1701 nt, Artificial Sequence; identical to SEQ ID NO: 96
  derived and/or modified CDS sequence (AUadapt) from InfluenzaA__AFR84774__HA

SEQ ID NO: 9920 - RNA, 1701 nt, Artificial Sequence
  derived and/or modified CDS sequence (AUadapt) from InfluenzaA__AFR84784__HA
augaaggccauccuggugggccuccuguacaccuucgccaccgcgaacgccgacacgcugugcaucggguaccacgccaacaacucgaccgacaccgucgacaccgugcucgagaagaacgugacggucacccacuccgugaacauccuggaggacaagcacaacggcaagcugugcaagcuccgcgggguggcgccccugcaccugggcaagugcaacaucgccggguggauccucggcaacccggagugcgagucgcuguccaccgccagcuccuggucguacaucgucgagaccuccagcuccgacaacggcacgugcuaccccggggacuucaucgacuacgaggagcugcgggagcagcucucguccgugagcuccuucgagcgcuucgagaucuuccccaagaccucguccuggcccaaccacgacucgaacaagggcgugaccgccgccugcccgcacgccggggcgaaguccuucuacaagaaccugaucuggcuggucaagaagggcaacagcuaccccaagcucuccaagucguacaucaacgacaaggggaaggaggugcuggugcuguggggcauccaccaccccagcaccuccgccgaccagcagucgcucuaccagaacgccgacgccuacgucuucgugggcuccagccgguacuccaagaaguucaagcccgagaucgccauccgcccgaaggugcgggaccaggaggggcgcaugaacuacuacuggacgcuggucgagcccggcgacaagaucaccuucgaggcgaccgggaaccugguggugccccgguacgccuucgccauggagcgcaacgccggcucgggcaucaucaucuccgacacccccguccacgacugcaacacgaccugccagaccccgaagggggccaucaacaccagccuccccuuccagaacauccaccccaucacgaucggcaagugccccaaguacgugaaguccaccaagcugcggcuggcgaccgggcuccgcaacgugccgucgauccagucccggggccuguucggggccaucgccggcuucaucgagggcggguggaccggcauggucgacgggugguacggcuaccaccaccagaacgagcaggggucgggcuacgccgccgaccugaaguccacgcagaacgcgaucgacgagaucaccaacaaggugaacagcgugaucgagaagaugaacacccaguucaccgccgucggcaaggaguucaaccaccucgagaagcgcaucgagaaccugaacaagaagguggacgacggguuccuggacaucuggacguacaacgccgagcuccugguccugcucgagaacgagcggacccuggacuaccacgacuccaacgugaagaaccuguacgagaaggugcgcucgcagcucaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcuggaguccacccgcaucuaccagauccucgcgaucuacucgaccguggccagcucccuggcccuggucgugucgcucggcgccaucuccuucuggaugugcagcaacggcucccugcagugccggaucugcaucuga

SEQ ID NO: 9921 - RNA, 1701 nt, Artificial Sequence; identical to SEQ ID NO: 96
  derived and/or modified CDS sequence (AUadapt) from InfluenzaA__AFR84794__HA

SEQ ID NO: 9922 - RNA, 1701 nt, Artificial Sequence; identical to SEQ ID NO: 116
  derived and/or modified CDS sequence (AUadapt) from InfluenzaA__AFR84804__HA

SEQ ID NO: 9923 - RNA, 1701 nt, Artificial Sequence; identical to SEQ ID NO: 96
  derived and/or modified CDS sequence (AUadapt) from InfluenzaA__AFR84814__HA

SEQ ID NO: 9924 - RNA, 1701 nt, Artificial Sequence; identical to SEQ ID NO: 116
  derived and/or modified CDS sequence (AUadapt) from InfluenzaA__AFR84824__HA

SEQ ID NO: 9925 - RNA, 1701 nt, Artificial Sequence; identical to SEQ ID NO: 2940
  derived and/or modified CDS sequence (AUadapt) from InfluenzaA__AFR84834__HA

SEQ ID NO: 9926 - RNA, 1701 nt, Artificial Sequence; identical to SEQ ID NO: 8114
  derived and/or modified CDS sequence (AUadapt) from InfluenzaA__AFR84844__HA

SEQ ID NO: 9927 - RNA, 1701 nt, Artificial Sequence; identical to SEQ ID NO: 3156
  derived and/or modified CDS sequence (AUadapt) from InfluenzaA__AFR84854__HA

SEQ ID NO: 9928 - RNA, 1701 nt, Artificial Sequence; identical to SEQ ID NO: 116
  derived and/or modified CDS sequence (AUadapt) from InfluenzaA__AFR84864__HA

SEQ ID NO: 9929 - RNA, 1701 nt, Artificial Sequence; identical to SEQ ID NO: 96
  derived and/or modified CDS sequence (AUadapt) from InfluenzaA__AFR84874__HA

SEQ ID NO: 9930 - RNA, 1701 nt, Artificial Sequence; identical to SEQ ID NO: 62
  derived and/or modified CDS sequence (AUadapt) from InfluenzaA__AFR84893__HA

SEQ ID NO: 9931 - RNA, 1701 nt, Artificial Sequence; identical to SEQ ID NO: 62
  derived and/or modified CDS sequence (AUadapt) from InfluenzaA__AFR84903__HA

SEQ ID NO: 9932 - RNA, 1701 nt, Artificial Sequence; identical to SEQ ID NO: 62
  derived and/or modified CDS sequence (AUadapt) from InfluenzaA__AFR84913__HA

SEQ ID NO: 9933 - RNA, 1701 nt, Artificial Sequence; identical to SEQ ID NO: 62
  derived and/or modified CDS sequence (AUadapt) from InfluenzaA__AFR84923__HA

SEQ ID NO: 9934 - RNA, 1689 nt, Artificial Sequence
  derived and/or modified CDS sequence (AUadapt) from InfluenzaA__AFV53205__HA
auggccaucaucuaccugauccuccuguucgccaccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcucgcugaacgacuacgaggagcugaagcaccuccuguccagcgugcggcacuucgagaaggugcgcauccugcccaaggaccgguggacgcagcacaccaccaccggggacuccaaggccugcgccgucucgggcaagcccuccuucuuccgcaacaugguguggcucacgaagaaggggcccgacuacccgguggcgaagggcucguacaacaacaccuccggggagcagaugcugaucaucuggggcguccaccaccccaucgacgaggccgagcagcgggagcuguaccagaaggugggcaccuacgugagcgccuccaccucgacgcucaacaagcgcuccauccccgagaucgccgcgcggcccgaggucaacgggcugcgcucgcggauggaguucuccuggacccugcucgacgugugggacaccaucaacuucgagagcaccggcaaccugaucgccccggaguacggguucaagaucuccaagcgcggcucgucgggcaucaugaagacggaggggacccugggcaacugcgagaccaagugccagacgccccucggggccaucaacaccacccugcccuuccacaacgugcacccccugaccaucggcgagugcccgaaguacgucaaguccgagaagcucgugcuggccaccgggcugcggaacgugccccagaucgagucgcgcggccucuucggcgccaucgcgggguucaucgagggcggguggcagggcauggucgacgggugguacggcuaccaccacuccaacgaccagggcagcggguacgccgccgacaaggaguccacgcagaaggccuucgacgagaucaccaacaaggugaacucggugaucgagaagaugaacacccaguucgaggccgucggcaaggaguucaacaaccuggagaagcggcuggagaaccucaacaagaagauggaggacggguuccuggacguguggaccuacaacgcggagcugcucgugcugauggagaacgagcgcacgcuggacuuccacgacuccaacgucaagaaccucuacgagaaggugcggaugcagcugcgcgacaacgucaaggagcugggcaacgggugcuucgaguucuaccacaagugcgacgacgagugcaucaacucggugaagaacggcaccuacgacuaccccaaguacgaggaggaguccaagcucaagcggaacgagaucaagggcgugaagcugagcuccaugggggucuaccagauccuggccaucuacgccaccguggccggcucgcucucccuggccaucaugauggcggggaucucguucuggaugugcuccaacggcagccugcagugccgcaucugcaucuga

SEQ ID NO: 9935 - RNA, 1689 nt, Artificial Sequence
  derived and/or modified CDS sequence (AUadapt) from InfluenzaA__AFV53216__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucagcggcaaccccuccuucuuccgcaacaugguguggcugacggagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccgacaucgccacgcggcccaaggugaacggccagggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucggcaacugcgagaccaagugccagaccccgcugggggccaucaacacgacccugcccuuccacaacgugcacccccucaccaucggcgagugccccaaguacgucaagucggagaagcuggugcuggcgaccgggcuccgcaacgugccgcagaucgagucccggggccuguucggggccaucgccggcuucaucgagggcggguggcagggcauggucgacgggugguacggcuaccaccacucgaacgaccagggguccggcuacgccgccgacaaggagucgacgcagaaggcguucgacggcaucaccaacaaggugaacuccgugaucgagaagaugaacacccaguucgaggccgucgagaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacucggugaagaacggcaccuacgacuaccccaaguacgaggaggaguccaagcugaaccggaacgagaucaagggcgugaagcugucguccauggggaucuaccagauccucgccaucuacgccaccgucgcgggcucgcugucccuggccaucaugauggccgggaucucguucuggaugugcuccaacggcagccuccagugccgcaucugcaucuga

SEQ ID NO: 9936 - RNA, 1689 nt, Artificial Sequence
  derived and/or modified CDS sequence (AUadapt) from InfluenzaA__AFV53227__HA
augaucaucaucuaccugauccuccuguucaccgccgugcgcggcgaccagaucugcaucggguaccacgccaacaacucgaccgagaaggucgacacgauccuggagcggaacgugaccgugacccacgcgaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagcuucaacgacuacgaggagcugaagcaccuccuguccucggugaagcacuucgagaaggugaagauccugcccaaggacggguggacgcagcacaagaccgacggcggguccaaggccugcgccgucagcggcaaggccuccuucuuccggaacaugguguggcugaccaaggaggggcccaacuaccagguggcgaagcgcucguacaacaacaccuccggcgagcagaugcucaucaucuggggcguccaccaccccaaggacgaggccgagcagaucgcccuguaccagaagguggggacguacgugagcgccuccaccucgacccugaacaagcgguccaccccggagaucgcggcccgccccgaggucaacggccucgggagccggauggaguucuccuggacgcugcuggacgugugggacaccaucaacuucgagucgaccggcaaccucguggcccccgaguacggcuucaagaucuccaagcgcgggucgagcggcaucaugaagaccgaggggacgcugggcaacugcgagaccaagugccagacgccccugggggccaucaacaccacccucccguuccacaacguccacccccugaccaucggcgagugccccaaguacgugaaguccgagaagcuggugcucgccaccggccugcggaacgucccccagaucgagucgcgcgggcuguucggcgcgaucgccggguucaucgagggcggguggcagggcaugguggacggcugguacggguaccaccacuccaacgaccagggcagcggguacgccgccgacaaggaguccacccagaaggccuucgaccggaucacgaacaaggugaacucggucaucgagaagaugaacauccaguucgaggcggugggcaaggaguucuccaaccucgagaagcgccuggagaaccugaacaagaagauggaggacggguuccucgacguguggaccuacaacgccgagcugcugguccucauggagaacgagcggacccuggacuuccacgacagcaacgugaagaaccuguacgacaagguccgcaugcagcuccgggacaacgugaaggagcugggcaacggcugcuucgaguucuaccacaagugcgacgacgagugcaugaacuccgugaagaacgggaccuacgacuacccgaaguacgaggaggagucgaagcugaagcgcaacgagaucaagggcgucaagcucuccagcauggggguguaccagauccuggccaucuacgccacgguggccggcucccugucgcucgcgaucaugaucgccggcaucuccuucuggaugugcagcaacgggucccugcagugccgggucugcaucuga

SEQ ID NO: 9937 - RNA, 1689 nt, Artificial Sequence
  derived and/or modified CDS sequence (AUadapt) from InfluenzaA__AFV53238__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagcuucaacgacuacgaggagcugaagcaccuccuguccucggugaagcacuucgagaaggugaagauccugcccaaggaccgguggacgcagcacaccaccaccgggggcuccauggccugcgccgucagcgggaagcccuccuucuuccgcaacaugguguggcugacgaccaagggccccaacuacccgguggcgcaggggucguacaacaacaccuccggcgagcagaugcucaucaucuggggcguccaccaccccaacgacgaggccgagcagcgggcccuguaccagaagguggggaccuacgugagcgccuccacgucgacccuguacaagcgcuccauccccgagaucgcggcccggcccaaggucaacggccucgggagccgcauggaguucuccuggacccugcuggacaugugggacaccaucaacuucgagucgacgggcaaccucguggccccggaguacggcuucaagaucuccaagcgggggucgagcggcaucaugaagaccgaggggacccuggagaacugcgagaccaagugccagacgccccugggcgccaucaacaccacccuccccuuccacaacgugcacccccugaccaucggggagugcccgaaguacgucaaguccgagaagcuggugcucgccacgggccugcgcaacgugccccagaucgagucgcggggccuguucggggcgaucgccggcuucaucgagggcggguggcaggggauggucgacggcugguacggcuaccaccacuccaacgaccaggggagcggcuacgccgccgacaaggaguccacccagaaggccuucgacgggaucaccaacaaggugaacucggugaucgagaagaugaacacccaguucgaggcggucggcaaggaguucuccaaccucgagaagcgccuggagaaccugaacaagaagauggaggacggguuccucgacguguggacguacaacgccgagcugcuggugcucauggagaacgagcggacccuggacuuccacgacagcaacgucaagaaccuguacgacaaggugcgcaugcagcuccgggacaacgucaaggagcugggcaacggcugcuucgaguucuaccacaagugcgacaacgagugcauggacuccgugaagaacgggaccuacgacuaccccaaguacgaggaggagucgaagcugaaccgcaacgagaucaagggcgugaagcucuccagcaugggggucuaccagauccuggccaucuacgccaccguggccggcucccugucgcucgcgaucaugauggccggcaucuccuucuggaugugcagcaacgggucccugcagugccggaucugcaucuga

SEQ ID NO: 9938 - RNA, 1689 nt, Artificial Sequence
  derived and/or modified CDS sequence (AUadapt) from InfluenzaA__AFV53249__HA
auggccaucaucuaccugauccuccuguucgccaccgugcgcggcgaccagaucugcaucggguaccacgcgaacaacucgaccgagacggucgacaccauccuggagcggaacgugaccgugacccacgccaaggacauccucgagaagacgcacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcucgcugaacgacuacgaggagcugaagcaccuccuguccagcgugaagcacuucgagaaggugcggauccugcccaaggaccgcuggaccaaccacaccaccaccgggggcuccaaggccugcgccgucucgggggagcccuccuucuuccggaacaugguguggcucacgaagaagggccccaacuacccgguggcgaaggggucguacaacaacaccuccggcgagcagaugcugaucaucuggggcguccaccaccccaacgacgaggccgagcagcgcgcccuguaccagaagguggggaccuacgugucggccuccacgagcacccucuacaagcgguccauccccgagaucgcggcccgccccaaggucaacggccuggggucgcggauggaguucuccuggacccugcucaacgugugggacaccaucaacuucgagucgacgggcaaccugguggccccggaguacggcuucaagaucuccaagcgcgggcggucgggcaucaugaagaccgaggggacccugggcaacugcgagaccaagugccagacgccccucggggccaucaacaccacccugcccuuccacaacguccacccccugaccaucggcgagugcccgaaguacgucaagagcgagaagcucgugcuggccacgggccugcgcaacgugccccagaucgagucccggggccucuucggggcgaucgccggguucaucgagggcggguggcagggcaugguggacggcugguacggguaccaccacucgaacgaccagggcuccggguacgccgccgacaaggagucgacccagaaggccuucgacggcaucaccaacaaggugaacuccgucaucgagaagaugaacacccaguucgaggcgguggggaaggaguucaacaaccuggagaagcgccuggagaaccucaacaagaagauggaggacggcuuccuggacguguggacguacaacgccgagcugcucguccugauggagaacgagcggacccuggacuuccacgacucgaacgugaagaaccucuacgagaagguccgcaugcagcugcgggacaacgugaaggagcugggcaacgggugcuucgaguucuaccacaagugcgacgacgagugcaugaacuccgugaagaacggcaccuacgacuaccccaaguacgaggaggagagcaagcucaagcgcaacgagaucaagggggucaagcuguccucgaugggcguguaccagauccuggccaucuacgccaccguggccggcucccucucgcuggcgaucauggucgccgggaucuccuucuggaugugcagcaacggcucccugcagugccggaucugcaucuga

SEQ ID NO: 9939 - RNA, 1698 nt, Artificial Sequence
  derived and/or modified CDS sequence (AUadapt) from InfluenzaA__AFV53260__HA
augaaggccaagcugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccgccugaagggcaaggcgccccuccagcuggggaacugcaacaucgccggcugggugcuggggaacccggagugcgagagccuccuguccaaccggucgugguccuacaucgccgagacccccaacagcgagaacgggaccugcuaccccggcgacuucgccgacuacgaggagcugcgcgagcagcucuccucgguguccucguucgagcgguucgagaucuuccccaaggagcgcuccuggccgaaccacaccacgcgcggggucaccgccgccugcccccacgcgaugaaguccagcuucuacaagaaccugguguggcugaccgaggccaacggcucguaccccaaccucucccggagcuacgugaacaaccaggagaaggagguccuggugcuguggggcgugcaccaccccuccaacaucgaggaccagcggacccucuaccgcaaggacaacgccuacgucucgguggugucguccaacuacaaccggcgcuucacgccggagaucgccaagcggcccaagguccgcggccagagcgggcggaucaacuacuacuggacccugcuggagcccggcgacaccaucaucuucgaggccaccggcaaccucaucgcgcccugguacgccuucgcccugucccgcgggccgggcucggggaucaucacguccaacgcgccccuggacgagugcgacaccaagugccagacgccccagggcgccaucaacagcucccuccccuuccagaacauccacccggugaccaucggcgagugccccaaguacgugcggucgaccaagcugcgcauggucaccgggcugcggaacauccccuccuuccagucgcgcggccucuucggggccaucgccggcuucaucgagggcggguggaccggcaugauggacgggugguacggcuaccaccaccagaacgagcagggguccggcuacgccgccgaccagaaguccacccagaacgccaucaacgggaucacgaacaaggugaacagcgugaucgagaagaugaacacccaguucaccgcggucggcaaggaguucaacaagcuggagaagcggauggagaaccugaacaagaagguggacgacggcuuccucgacaucuggaccuacaacgccgagcugcuggugcuccuggagaacgagcgcacgcuggacuuccacgacucgaacgucaagaaccucuacgagaaggugaagaaccagcugcggaacaacgccaaggagcuggggaacggcugcuucgaguucuaccacaagugcgacaacgagugcauggaguccgucaagaacgggaccuacgacuaccccaaguacagcgaggaguccaagcucaaccgcgagaagaucgacggcgugaagcuggagucgauggggguguaccgcauccuggccaucuacuccaccgucgccucgagccucgugcugcuggugucccucggcgcgaucucguucuggaugugcuccaacggcagccugcagugccggaucugcaucuga

SEQ ID NO: 9940 - RNA, 1689 nt, Artificial Sequence
  derived and/or modified CDS sequence (AUadapt) from InfluenzaA__AFV53271__HA
auggccaucaccuaccugauccuccuguucaccgccgugcgcggcgaccagaucugcaucggguaccacgcgaacaacucgacggagaaggucgacaccauccuggagcggaacgugaccgugacccacgccaaggacauccucgagaagacgcacaacggcaagcugugcaagcugaacgggaucccgccccucgagcugggcgacugcuccaucgccggguggcugcucggcaaccccgagugcgaccgcuuccugcggguccccgaguggucguacaucauggagaaggagaacccccgcuacucccugugcuacccgggcagcuucaacgacuacgaggagcucaagcaccuccuguccucggugaagcacuucgagaaggugaagauccugcccaaggacggguggacccagcacaccaccacgggcggguccauggccugcgccgucucgggcaagcccuccuucuuccggaacaugguguggcugaccgagaaggggcagaacuaccccguggcgaagggcagcuacaacaacaccuccggcgagcagaugcugaucaucuggggcguccaccacccgaacgacgaggccgagcagcgcgcccucuaccagaagguggggaccuacgugucggccuccacgucgacccugaacaagcgguccacccccgagaucgcggcccgccccaaggucaacgggcugggcagccggauggaguucuccuggacccuccuggacaugugggacacgaucaacuucgagucgaccggcaaccugguggcccccgaguacggguucaagaucuccaagcgcggcucgagcgggaucaugaagaccgagggcacccucgagaacugcgagacgaagugccagaccccgcugggggccaucaacaccacccugcccuuccacaacgugcacccccucacgaucggcgagugccccaaguacgucaaguccgagaagcuggugcuggccaccggccuccggaacaucccgcagaucgagucgcgcgggcuguucggcgcgaucgccggguucaucgagggcggguggcagggcaugguggacggcugguacggguaccaccacuccaacgaccagggcucgggguacgccgccgacaaggaguccacccagaaggccuucgacggcaucaccaacaaggucaacagcgugaucgagaagaugaacacgcaguucgaggcgguggggaaggaguucuccaaccuggagaagcggcucgagaaccugaacaagaagauggaggacggcuuccuggacgucuggaccuacaacgccgagcuccuggugcugauggagaacgagcgcacccucgacuuccacgacucgaacgugaagaaccuguacgacaagguccggaugcagcugcgcgacaacgugaaggagcucggcaacgggugcuucgaguucuaccacaagugcgacaacgagugcauggacuccgucaagaacggcaccuacgacuaccccaaguacgaggaggagucgaagcugaaccggaacgagaucaagggggugaagcuguccagcaugggcguguaccagauccucgccaucuacgccacggucgccggcucccugucgcuggcgaucaugauggccgggaucuccuucuggaugugcagcaacggcucccuccagugccgcaucugcaucuga

SEQ ID NO: 9941 - RNA, 1689 nt, Artificial Sequence
  derived and/or modified CDS sequence (AUadapt) from InfluenzaA__AFV53282__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggaccaacuaccccguggcgaagggcucguacaacaacaccuccggcgagcagaugcucaucaucuggggcguccaccacccgaacgacgagaccgagcagcggacgcuguaccagaacguggggaccuacgugagcgucgggaccuccacccugaacaagcgcucgacgcccgagaucgccacccggcccaaggugaacggccucggcucccgcauggaguucucguggacccugcuggacaugugggacaccaucaacuucgaguccacggggaaccucaucgcccccgaguacggcuucaagaucagcaagcggggguccucgggcaucaugaagaccgaggggacccuggagaacugcgagaccaagugccagacgccgcugggcgccaucaacaccacccuccccuuccacaacgugcacccccugaccaucggcgagugccccaaguacgucaagcuggagaagcucgugcuggcgacggggcugcgcaacgugccgcagaucgagucgcggggccucuucggggccaucgccggcuucaucgagggcggguggcagggcauggucgacgggugguacggcuaccaccacuccaacgaccaggggagcggcuacgccgccgacaaggaguccacccagaaggcguucgacgugaucaccaacaaggugaacucggucaucgagaagaugaacacccaguucgaggccguggggaaggaguucuccaaccuggagcgccggcuggagaaccucaacaagaagauggaggacggcuuccuggacguguggacguacaacgccgagcugcucguccugauggagaacgagcgcacccuggacuuccacgacucgaacgugaagaaccucuacgacaagguccggaugcagcugcgcgacaacgugaaggagcugggcaacgggugcuucgaguucuaccacaagugcgacgacgagugcaugaacuccgugaagaacggcaccuacgacuaccccaaguacgaggaggagagcaagcucaaccggaacgagaucaagggggucaagcuguccucgaugggcguguaccagauccuggccaucuacgccaccguggcgggcucccucucgcuggccaucaugauggccgggaucuccuucuggaugugcagcaacggcucccugcagugccgcaucugcaucuga

SEQ ID NO: 9942 - RNA, 1689 nt, Artificial Sequence
  derived and/or modified CDS sequence (AUadapt) from InfluenzaA__AFV53293__HA
auggccaucaucuaccugauccuccuguucaccucggugcgcggcgaccagaucugcaucggguaccacgccaacaacuccaccgagaaggucgacacgauccuggagcggaacgugaccgugacccacgcgaagaacauccucgagaagacccacaacggcaagcugugcaagcugaacgggaucccgccccucgagcugggcgacugcucgaucgccggguggcugcucggcaaccccgagugcgaccgccugcugcggguccccgagugguccuacaucauggagaaggagaaccccaaguacagccucugcuacccgggcuccuucaacgacuacgaggagcugaagcaccuccugucguccgugaagcacuucgagaaggugaagauccugcccaaggacggguggacgcagcacaccaccaacggcgggucgcgcgccugcgccgucuccggcaaccccagcuucuuccggaacaugguguggcugaccaagaaggggcccaacuacccgguggccaagggcuccuacaacaacacgucgggcgagcagaugcucaucaucuggggcguccaccaccccaacgacgaggcggagcagcgcgcccuguaccaggagguggggaccuacguguccgccucgaccuccacccugaacaagcggagcacgcccgagaucgccgcgcgccccaaggucaacgggcucggcucccggauggaguucucguggacccugcuggacaugugggacaccaucaacuucgaguccaccggcaaccucguggccccggaguacggguucaagaucucgaagcgcggcagcuccggggugaugaagacggagggcacccuggagaacugcgagaccaagugccagacgccccugggggccaucaacaccacccuccccuuccacaacguccacccccugaccaucggcgagugcccgaaguacgucaagucggagaagcuggugcucgccaccggccugcggaacgugccccagaucgagucccgcgggcuguucggcgccaucgcgggguucaucgagggcggguggcagggcaugguggacggcugguacggguaccaccacucgaacgaccagggcuccggguacgccgccgacaaggagagcacgcagaaggccuucgacggcaucaccaacaaggugaacuccgucaucgagaagaugaacacccaguucgaggccguggggaaggaguucucgaaccucgagaagcggcuggagaaccugaacaagaagauggaggacggcuuccucgacguguggaccuacaacgcggagcugcugguccucauggagaacgagcgcacgcuggacuuccacgacuccaacgugaagaaccuguacgacaagguccggaugcagcuccgcgacaacgugaaggagcugggcaacgggugcuucgaguucuaccacaagugcgacgacgagugcauggacucggugaagaacggcaccuacgacuaccccaaguacgaggaggaguccaagcugaaccggaacgagaucaagggggucaagcucagcuccaugggcguguaccagauccuggccaucuacgccaccguggccggcucgcugucccucgccaucaugauggcggggaucucguucuggaugugcuccaacggcagccugcagugccgcaucugcaucuga

SEQ ID NO: 9943 - RNA, 1689 nt, Artificial Sequence
  derived and/or modified CDS sequence (AUadapt) from InfluenzaA__AFV53304__HA
auggccaucaucuaccugauccuccuguucaccgccgugcgcggcgaccagaucugcaucggguaccacgcgaacaacucgaccgagaaggucgacacgauccuggagcagaacgugaccgugacccacgccaaggacauccucgagaagacccacaacggcaagcugugcaagcugaacgggaucccgccccucgagcugggcgacugcuccaucgccggguggcugcucggcaaccccgagugcgaccggcugcugucgguccccgagugguccuacaucauggagaaggagaacccccgcgacggccucugcuacccggggucguucaacgacuacgaggagcugaagcaccuccuguccagcgugaagcacuucgagaaggugaagauccugcccaaggaccgguggacgcagcacaccaccaccggcgggucccgcgccugcgccgucucgggcaaccccuccuucuuccggaacaugguguggcugacgaagaaggagucgaacuaccccguggcgaagggguccuacaacaacaccagcggcgagcagaugcucaucaucuggggcguccaccacccgaacgacgagaccgagcagcgcacccuguaccagaacguggggacguacguguccgucggcaccucgacccugaacaagcgguccacccccaacaucgccacgcgccccaaggugaacgggcucggcucgcggauggaguucuccuggacccugcuggacaugugggacaccaucaacuucgagagcaccggcaaccucaucgcccccgaguacggguucaagaucuccaagcgcggcucgucggggaucaugaagacggagggcacccuggagaacugcgagaccaagugccagaccccgcugggggccaucaacacgacccuccccuuccacaacgugcacccccugaccaucggcgagugccccaaguacgucaaguccgagaagcuggugcucgcgaccggccugcggaacgugccgcagaucgagucgcgcgggcuguucggcgccaucgccggguucaucgagggcggguggcagggcauggucgacggcugguacggguaccaccacuccaacgaccagggcagcggguacgccgccgacaaggaguccacgcagaaggcguucgacggcaucaccaacaaggugaacucggugaucgagaagaugaacacccaguucgaggccgucgggaaggaguucuccaaccucgagcggcgccuggagaaccugaacaagaagauggaggacggcuuccucgacguguggaccuacaacgccgagcugcuggugcucauggagaacgagcggacgcuggacuuccacgacucgaacgucaagaaccuguacgacaaggugcgcaugcagcuccgggacaacgucaaggagcugggcaacgggugcuucgaguucuaccacaagugcgacgacgagugcaugaacuccgugaagaacggcaccuacgacuaccccaaguacgaggaggagagcaagcugaaccgcaacgagaucaagggggugaagcucuccucgaugggcgucuaccagauccuggccaucuacgccaccguggcgggcucccugucgcucgccaucaugauggccgggaucuccuucuggaugugcagcaacggcucccugcagugccggaucugcaucuga

SEQ ID NO: 9944 - RNA, 1689 nt, Artificial Sequence
  derived and/or modified CDS sequence (AUadapt) from InfluenzaA__AFV53314__HA
auggccaucaucuaccugauccuccuguucaccgccgugcgcggcgacaagaucugcaucggguaccacgcgaacaacucgaccgagacggucgacaccauccuggagcggaacgugaccgugacccacgccaaggacauccucgagaagacgcacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccggaacggccucugcuacccggggaacuucaacgacuacgaggagcugaagcaccuccugucguccgugaagcacuucgagaaggugaagauccugcccaaggaccgcuggacccagcacaccaccacgggcgggagccaggccugcgccgucuccggcaaccccucguucuuccggaacaugguguggcugaccgagaaggaguccaacuaccccguggcgaaggggucguacaacaacaccuccggcgagcagaugcucaucaucuggggcguccaccacccgaucgacgagaccgagcagcgcacgcuguaccagaacguggggaccuacgugucggucggcaccuccacccugaacaagcggagcacgcccgagaucgccaagcgccccaaggugaacgggcucggcucccggauggaguucucguggacccugcuggacaugugggacaccaucaccuucgaguccacgggcaaccucaucgcccccgaguacggguucaagaucucgaagcgcggcuccucggggaucaugaagaccgagggcacccuggagaacugcgagaccaagugccagacgccgcugggggccaucaacaccacccuccccuuccacaacgugcacccccugaccaucggcgagugccccaaguacgucaagagcgagaagcuggugcucgcgacgggccugcggaacgugccgcagaucgagucccgcgggcuguucggcgccaucgccggguucaucgagggcggguggcagggcauggucgacggcugguacggguaccaccacucgaacgaccagggcuccggguacgccgccgacaaggagucgacccagaaggcguucgacggcaucaccaacaaggugaacgccgugaucgagaagaucaacacccaguucgaggccgucgggaaggaguucuccaaccucgagcggcgccuggagaaccugaacaagaagauggaggacggcuuccucgacguguggacguacaacgccgagcugcuggugcucauggagaacgagcggacccuggacuuccacgacucgaacgucaagaaccuguacgacaaggugcgcaugcagcuccgggacaacgucaaggagcugggcaacgggugcuucgaguucuaccacaagugcgacgacgagugcaugaacuccgugaagaacggcaccuacgacuaccccaaguacgaggaggagagcaagcugaaccgcaacgagaucaagggggugaagcucuccucgaugggcgucuaccagauccuggccaucuacgcgaccguggccggcucccugucgcucgccaucaugauggccgggaucuccuucuggaugugcagcaacggcucccugcagugccggaucugcaucuga

SEQ ID NO: 9945 - RNA, 1689 nt, Artificial Sequence
  derived and/or modified CDS sequence (AUadapt) from InfluenzaA__AFV53325__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggagcuucaacgacuacgaggagcugaagcaccuccuguccucggugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggagcaacuacaccguggcgaagggcuccuacaacaacaccucgggcgagcagaugcucaucaucuggggcguccaccaccccaacgacgagaccgagcagcggacgcuguaccagaacguggggaccuacguguccgucucgaccuccacccugaacaagcgcagcacgccggagaucgccacccggcccaaggugaacgggcucggcucccgcauggaguucucguggacccugcuggacaugugggacaccaucaacuucgaguccacgggcaaccucaucgcccccgaguacggguucaagaucucgaagcggggcagcuccgggaucaugaagaccgagggcacccuggagaacugcgagaccaagugccagacgccccugggggccaucaacaccacccucccguuccacaacgugcacccccugaccaucggcgagugccccaaguacgucaagucggagaagcuggugcucgcgacgggccugcgcaacgugccccagaucgagucccgggggcuguucggcgccaucgccggguucaucgagggcggguggcagggcauggucgacggcugguacggguaccaccacucgaacgaccagggcuccggguacgccgccgacaaggagagcacccagaaggcguucgacggcaucaccaacaaggugaacuccgugaucgagaagaugaacacccaguucgaggccgucgggaaggaguucucgaaccucgagcgccggcuggagaaccugaacaagaagauggaggacggcuuccucgacguguggacguacaacgccgagcugcuggugcucauggagaacgagcgcacccuggacuuccacgacuccaacgucaagaaccuguacgacaaggugcggaugcagcuccgcgacaacgucaaggagcugggcaacgggugcuucgaguucuaccacaagugcgacgacgagugcaugaacucggugaagaacggcaccuacgacuacccgaaguacgaggaggaguccaagcugaaccggaacgagaucaagggggugaagcucagcuccaugggcgucuaccagauccuggccaucuacgccaccguggcgggcucgcugucccucgccaucaugauggccgggaucucguucuggaugugcuccaacggcagccugcagugccgcaucugcaucuga

SEQ ID NO: 9946 - RNA, 1689 nt, Artificial Sequence
  derived and/or modified CDS sequence (AUadapt) from InfluenzaA__AFV53336__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagcuucaacgacuacgaggagcugaagcaccuccucuccucggugaagcaccuggagaaggugaagauccugcccaaggacggguggacgcagcacgagaccgacggcggguccaaggccugcgccgucucgggcaagcccuccuucuuccggaacaugguguggcucaccaagaaggggcccaacuacccgguggcgaagcgcagcuacaacaacaccuccggcgagcagaugcugaucaucuggggcguccaccaccccaacgacgaggccgagcagcgggcccuguaccagaagguggggacguacgugucggccuccaccagcacccucaacaagcgcuccacccccgagaucgcggcccggcccgaggucucgggccuggggucccgcauggaguucucguggacgcugcucgacgugugggacaccaucuccuucgagagcaccggcaaccugguggccccggaguacggcuucaagaucucgaagcggggguccucgggcaucaugaagaccgaggggacgcugggcaacugcgagaccaagugccagacgccccucggggccaucaacaccacccugcccuuccacaacguccacccccugaccaucggcgagugcccgaaguacgugaaguccgagaagcucgugcuggccaccggccugcgcaacgucccccagaucgagagccgggggcuguucggcgcgaucgccggguucaucgagggcggguggcagggcaugguggacggcugguacggguaccaccacuccaacgaccagggcucgggguacgccgccgacaaggaguccacccagaaggccuucgaccgcaucacgaacaaggugaacagcgucaucgagaagaugaacacccaguucgaggcggugggcaaggaguucuccaaccuggagaagcggcuggagaaccucaacaagaagauggaggacggguuccuggacguguggaccuacaacgccgagcugcucguccugauggagaacgagcgcauccuggacuuccacgacucgaacgugaagaaccucuacgacaagguccggaugcagcugcgcgacaacgugaaggagcugggcaacggcugcuucgaguucuaccacaagugcgacgacgagugcaugaacuccgugaagaacgggaccuacgacuaccccaaguacgaggaggagucgaagcucaagcggaacgagaucaagggcgucaagcuguccagcauggggguguaccagauccuggccaucuacgccacgguggccggcucccucucgcuggcgaucaugaucgccggcaucuccuucuggaugugcagcaacgggucccugcagugccgcaucugcaucuga

SEQ ID NO: 9947 - RNA, 1701 nt, Artificial Sequence
  derived and/or modified CDS sequence (AUadapt) from InfluenzaA__AFV68720__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccgacucguccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcagccagcaggccgugaucccgaacaucggcucccggccccgcauccggaacauccccucgcgcaucuccaucuacuggaccaucgucaagcccggcgacauccugcucaucaacagcaccgggaaccugaucgccccgcggggcuacuucaagauccgcuccgggaaguccuccaucaugcggucggacgcccccaucggcaagugcaacuccgagugcaucacccccaacggcagcauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 9948 - RNA, 1701 nt, Artificial Sequence; identical to SEQ ID NO: 116
  derived and/or modified CDS sequence (AUadapt) from InfluenzaA__AFX96347__HA

SEQ ID NO: 9949 - RNA, 1701 nt, Artificial Sequence
  derived and/or modified CDS sequence (AUadapt) from InfluenzaA__AFX96359__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucaacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 9950 - RNA, 1701 nt, Artificial Sequence
  derived and/or modified CDS sequence (AUadapt) from InfluenzaA__AFX96366__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgaccggggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccagcuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9951 - RNA, 1701 nt, Artificial Sequence; identical to SEQ ID NO: 4414
  derived and/or modified CDS sequence (AUadapt) from InfluenzaA__AFX96383__HA

SEQ ID NO: 9952 - RNA, 1701 nt, Artificial Sequence; identical to SEQ ID NO: 116
  derived and/or modified CDS sequence (AUadapt) from InfluenzaA__AFX96398__HA

SEQ ID NO: 9953 - RNA, 1701 nt, Artificial Sequence; identical to SEQ ID NO: 116
  derived and/or modified CDS sequence (AUadapt) from InfluenzaA__AFX96408__HA

SEQ ID NO: 9954 - RNA, 1701 nt, Artificial Sequence; identical to SEQ ID NO: 116
  derived and/or modified CDS sequence (AUadapt) from InfluenzaA__AFX96418__HA

SEQ ID NO: 9955 - RNA, 1701 nt, Artificial Sequence; identical to SEQ ID NO: 116
  derived and/or modified CDS sequence (AUadapt) from InfluenzaA__AFX96428__HA

SEQ ID NO: 9956 - RNA, 1701 nt, Artificial Sequence; identical to SEQ ID NO: 116
  derived and/or modified CDS sequence (AUadapt) from InfluenzaA__AFX96438__HA

SEQ ID NO: 9957 - RNA, 1701 nt, Artificial Sequence; identical to SEQ ID NO: 116
  derived and/or modified CDS sequence (AUadapt) from InfluenzaA__AFX96448__HA

SEQ ID NO: 9958 - RNA, 1701 nt, Artificial Sequence; identical to SEQ ID NO: 116
  derived and/or modified CDS sequence (AUadapt) from InfluenzaA__AFX96458__HA

SEQ ID NO: 9959 - RNA, 1701 nt, Artificial Sequence; identical to SEQ ID NO: 116
  derived and/or modified CDS sequence (AUadapt) from InfluenzaA__AFX96468__HA

SEQ ID NO: 9960 - RNA, 1701 nt, Artificial Sequence; identical to SEQ ID NO: 116
  derived and/or modified CDS sequence (AUadapt) from InfluenzaA__AFX96478__HA

SEQ ID NO: 9961 - RNA, 1701 nt, Artificial Sequence; identical to SEQ ID NO: 116
  derived and/or modified CDS sequence (AUadapt) from InfluenzaA__AFX96488__HA

SEQ ID NO: 9962 - RNA, 1701 nt, Artificial Sequence
  derived and/or modified CDS sequence (AUadapt) from InfluenzaA__AFX96498__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagaucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 9963 - RNA, 1701 nt, Artificial Sequence; identical to SEQ ID NO: 116
  derived and/or modified CDS sequence (AUadapt) from InfluenzaA__AFX96508__HA

SEQ ID NO: 9964 - RNA, 1701 nt, Artificial Sequence; identical to SEQ ID NO: 4414
  derived and/or modified CDS sequence (AUadapt) from InfluenzaA__AFX96518__HA

SEQ ID NO: 9965 - RNA, 1701 nt, Artificial Sequence; identical to SEQ ID NO: 116
  derived and/or modified CDS sequence (AUadapt) from InfluenzaA__AFX96528__HA

SEQ ID NO: 9966 - RNA, 1701 nt, Artificial Sequence; identical to SEQ ID NO: 4414
  derived and/or modified CDS sequence (AUadapt) from InfluenzaA__AFX96538__HA

SEQ ID NO: 9967 - RNA, 1701 nt, Artificial Sequence
  derived and/or modified CDS sequence (AUadapt) from InfluenzaA__AFX96548__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 9968 - RNA, 1701 nt, Artificial Sequence; identical to SEQ ID NO: 116
  derived and/or modified CDS sequence (AUadapt) from InfluenzaA__AFX96558__HA

SEQ ID NO: 9969 - RNA, 1701 nt, Artificial Sequence; identical to SEQ ID NO: 4074
  derived and/or modified CDS sequence (AUadapt) from InfluenzaA__AFX96568__HA

SEQ ID NO: 9970 - RNA, 1701 nt, Artificial Sequence; identical to SEQ ID NO: 4074
  derived and/or modified CDS sequence (AUadapt) from InfluenzaA__AFX96578__HA

SEQ ID NO: 9971 - RNA, 1701 nt, Artificial Sequence; identical to SEQ ID NO: 116
  derived and/or modified CDS sequence (AUadapt) from InfluenzaA__AFX96588__HA

SEQ ID NO: 9972 - RNA, 1701 nt, Artificial Sequence; identical to SEQ ID NO: 116
  derived and/or modified CDS sequence (AUadapt) from InfluenzaA__AFX96598__HA

SEQ ID NO: 9973 - RNA, 1701 nt, Artificial Sequence
  derived and/or modified CDS sequence (AUadapt) from InfluenzaA__AFX96608__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggcgaucuacuccacccuggccucgagccucguccugguggugucccugggggccaucucguucuggaugugcuccaacggcagccuccagugccggaucugcaucuga

SEQ ID NO: 9974 - RNA, 1701 nt, Artificial Sequence; identical to SEQ ID NO: 116
  derived and/or modified CDS sequence (AUadapt) from InfluenzaA__AFX96618__HA

SEQ ID NO: 9975 - RNA, 1701 nt, Artificial Sequence; identical to SEQ ID NO: 4074
  derived and/or modified CDS sequence (AUadapt) from InfluenzaA__AFX96628__HA

SEQ ID NO: 9976 - RNA, 1701 nt, Artificial Sequence
  derived and/or modified CDS sequence (AUadapt) from InfluenzaA__AFX96638__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugguguggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucauggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9977 - RNA, 1701 nt, Artificial Sequence; identical to SEQ ID NO: 116
  derived and/or modified CDS sequence (AUadapt) from InfluenzaA__AFX96648__HA

SEQ ID NO: 9978 - RNA, 1701 nt, Artificial Sequence; identical to SEQ ID NO: 4074
  derived and/or modified CDS sequence (AUadapt) from InfluenzaA__AFX96658__HA

SEQ ID NO: 9979 - RNA, 1701 nt, Artificial Sequence
  derived and/or modified CDS sequence (AUadapt) from InfluenzaA__AFX96668__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugcagcaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 9980 - RNA, 1701 nt, Artificial Sequence
  derived and/or modified CDS sequence (AUadapt) from InfluenzaA__AFX96678__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcucccacgccggcgccaagagcuucuacaagaaccugaucuggcucgugaagaaggggaacuccuacccgaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccgggucgggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 9981 - RNA, 1701 nt, Artificial Sequence
  derived and/or modified CDS sequence (AUadapt) from InfluenzaA__AFX96688__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggacugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgacggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 9982 - RNA, 1701 nt, Artificial Sequence; identical to SEQ ID NO: 116
  derived and/or modified CDS sequence (AUadapt) from InfluenzaA__AFX96698__HA

SEQ ID NO: 9983 - RNA, 1701 nt, Artificial Sequence
  derived and/or modified CDS sequence (AUadapt) from InfluenzaA__AFX96718__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagaucuccaagagcuacaucaacgacaagggcaaggaggugcugguccugugggggauccaccaccccucgaccuccgccgaccagcagagccucuaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccugguggucccccgguacgcguucgccauggagcgcaacgccggguccggcaucaucaucagcgacacccccgugcacgacugcaacacgaccugccagaccccgaagggcgccaucaacaccucccuccccuuccagaacauccaccccaucaccaucgggaagugccccaaguacgucaagucgaccaagcugcggcuggccacgggccuccgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaaggccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcuggagagcacccgcaucuaccagauccucgccaucuacuccaccguggcgucgagccugguccugguggugucccucggggccaucucguucuggaugugcuccaacggcagccugcagugccggaucugcaucuga

SEQ ID NO: 9984 - RNA, 1701 nt, Artificial Sequence; identical to SEQ ID NO: 9983
  derived and/or modified CDS sequence (AUadapt) from InfluenzaA__AFX96728__HA

SEQ ID NO: 9985 - RNA, 1701 nt, Artificial Sequence; identical to SEQ ID NO: 3384
  derived and/or modified CDS sequence (AUadapt) from InfluenzaA__AFX96738__HA

SEQ ID NO: 9986 - RNA, 1701 nt, Artificial Sequence
  derived and/or modified CDS sequence (AUadapt) from InfluenzaA__AFX96748__HA
augaaggccauccuggugguccuccuguacaccaucgccaccgcgaacgccgacacgcugugcaucggcuaccacgccaacaacucgaccgacaccguggacaccgugaucgagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagauguuccccaagaccucguccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 9987 - RNA, 1701 nt, Artificial Sequence
  derived and/or modified CDS sequence (AUadapt) from InfluenzaA__AFX96758__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 9988 - RNA, 1701 nt, Artificial Sequence
  derived and/or modified CDS sequence (AUadapt) from InfluenzaA__AFX96768__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaucucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccaccaagaucuaccagauccuggcgaucuacucgaccgucgccuccagccuggugcucguggucucgcugggggccaucuccuucuggaugugcagcaacggcucccugcagugccgcaucugcaucuga

SEQ ID NO: 9989 - RNA, 1701 nt, Artificial Sequence
  derived and/or modified CDS sequence (AUadapt) from InfluenzaA__AFX96778__HA
augaaggccauccuggugauccuccuguacaccuucgccaccgcgaacgccgacacgcugugcaucggcuaccacgccaacaacucgaccgacaccgucgacaccauccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 9990 - RNA, 1701 nt, Artificial Sequence
  derived and/or modified CDS sequence (AUadapt) from InfluenzaA__AFX96788__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 9991 - RNA, 1701 nt, Artificial Sequence; identical to SEQ ID NO: 9990
  derived and/or modified CDS sequence (AUadapt) from InfluenzaA__AFX96798__HA

SEQ ID NO: 9992 - RNA, 1701 nt, Artificial Sequence; identical to SEQ ID NO: 4074
  derived and/or modified CDS sequence (AUadapt) from InfluenzaA__AFX96808__HA

SEQ ID NO: 9993 - RNA, 1701 nt, Artificial Sequence; identical to SEQ ID NO: 7154
  derived and/or modified CDS sequence (AUadapt) from InfluenzaA__AFX96818__HA

SEQ ID NO: 9994 - RNA, 1701 nt, Artificial Sequence; identical to SEQ ID NO: 9990
  derived and/or modified CDS sequence (AUadapt) from InfluenzaA__AFX96828__HA

SEQ ID NO: 9995 - RNA, 1701 nt, Artificial Sequence; identical to SEQ ID NO: 5511
  derived and/or modified CDS sequence (AUadapt) from InfluenzaA__AFX96838__HA

SEQ ID NO: 9996 - RNA, 1701 nt, Artificial Sequence
  derived and/or modified CDS sequence (AUadapt) from InfluenzaA__AFX96856__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcacccacgccggcgcgaaguccuucuacaagaaccugaucuggcucgugaagaaggggaacucguacccgaagcuguccaagagcuacaucaacgacaagggcaaggaggugcugguccucugggggauccaccaccccucgacguccgccgaccagcagagccuguaccagaacgccgacgccuacguguucgugggcaccucccgguacucgaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucgccauggagcgcaacgccggguccggcaucaucaucagcgacacccccgugcacgacugcaacacgaccugccagacccccaagggcgccaucaacaccucccugccguuccagaacauccaccccaucaccaucgggaagugccccaaguacgucaagucgaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 9997 - RNA, 1701 nt, Artificial Sequence; identical to SEQ ID NO: 9979
  derived and/or modified CDS sequence (AUadapt) from InfluenzaA__AFX96904__HA

SEQ ID NO: 9998 - RNA, 1701 nt, Artificial Sequence; identical to SEQ ID NO: 4414
  derived and/or modified CDS sequence (AUadapt) from InfluenzaA__AFX96914__HA

SEQ ID NO: 9999 - RNA, 1701 nt, Artificial Sequence
  derived and/or modified CDS sequence (AUadapt) from InfluenzaA__AFX96924__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagcgcuucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 10000 - RNA, 1701 nt, Artificial Sequence; identical to SEQ ID NO: 116
  derived and/or modified CDS sequence (AUadapt) from InfluenzaA__AFX96934__HA

SEQ ID NO: 10001 - RNA, 1701 nt, Artificial Sequence
  derived and/or modified CDS sequence (AUadapt) from InfluenzaA__AFY24097__HA
augaaggccauccuggugguccuccuguacaccuucgccaccgcgaacgccgacacgcugugcaucggcuaccacgccgacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucgacggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 10002 - RNA, 1701 nt, Artificial Sequence; identical to SEQ ID NO: 875
  derived and/or modified CDS sequence (AUadapt) from InfluenzaA__AFY24162__HA

SEQ ID NO: 10003 - RNA, 1701 nt, Artificial Sequence
  derived and/or modified CDS sequence (AUadapt) from InfluenzaA__AFY24195__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcauccggaacauccccucccgcaucagcaucuacuggaccaucgucaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 10004 - RNA, 1701 nt, Artificial Sequence; identical to SEQ ID NO: 430
  derived and/or modified CDS sequence (AUadapt) from InfluenzaA__AFY24217__HA

SEQ ID NO: 10005 - RNA, 1701 nt, Artificial Sequence
  derived and/or modified CDS sequence (AUadapt) from InfluenzaA__AGB08294__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcaggccggcgcgaaguccuucuacaagaaccugaucuggcucgugaagaaggggaacagcuaccccaagcugaucaaguccuacaucaacgacaagggcaaggaggugcugguccucugggggauccaccaccccucgaccagcgccgaccagcagucccuguaccagaacgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgugauggagcggaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcuccgccuggccaccggccugcggaacaucccgucgauccagucccgcggccucuucggggcgaucgccggguucaucgagggcggcuggacggggaugguggacggcugguacggguaccaccaccagaacgcccagggcagcggguacgccgccgaccugaaguccacccagaacgcgaucgacaagaucaccaacaaggugaacucggucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuacccccgcuacucggaggaggccaagcucaaccgggaggagaucgacggcgugaagcuggaguccacccgcaucuaccagauccuggcgaucuacagcaccgucgccuccucgcucgugcugguggucagccugggggccaucuccuucuggaugugcagcaacggcucccuccagugccggaucugcaucuga

SEQ ID NO: 10006 - RNA, 1701 nt, Artificial Sequence
  derived and/or modified CDS sequence (AUadapt) from InfluenzaA__AGB08295__HA
augaaggccauccuggugguccuccuguacaccuucgccaccgcgaacgccgacacgcugugcaucggcuaccacgccaacaacucgaccgacaccguggacaccgugaucgagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucaacuacgaggagcugcgggagcagcucucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagcggaaggaggugcugguccuguggggcauccaccaccccagcaccacggccgaccagcagucccucuaccagaacgccgacgccuacguguucguggggaccucgcgcuacuccaagaaguucaagcccgagaucgccauccggccgaagguccgcgaccaggagggccggaugaacuacuacuggacccugguggagcccggcgacaagaucaccuucgaggcgacggggaaccugguggucccccgcuacgccuucgccauggagcggaccgccggcucggggaucaucaucuccgacacccccgugcacgacugcaacaccacgugccagaccccgaagggcgccaucaacaccagccuccccuuccagaacauccaccccaucaccaucggcaagugccccaaguacgugaaguccacgaagcugcgccuggcgaccgggcuccggaacaucccgucgauccagucccgcggccuguucggggccaucgccggcuucaucgagggcggguggaccggcauggucgacgggugguacggcuaccaccaccagaacgagcaggggagcggcuacgccgccgaccugaaguccacccagaacgcgaucgacaagaucacgaacaaggugaacucggugaucgagaagaugaacacccaguucaccgccgucgggaaggaguucaaccaccucgagaagcggaucgagaaccugaacaagaagguggacgacggcuuccuggacaucuggaccuacaacgccgagcuccugguccugcucgagaacgagcgcacgcuggacuaccacgacuccaacgugaagaaccuguacgagaaggugcggaaccagcucaagaacaacgccaaggagaucggcaacgggugcuucgaguucuaccacaagugcgacaacacgugcauggagucggucaagaacggcaccuacgacuaccccaaguacuccgaggaggccaagcugaaccgcgaggagaucgacggggugaagcuggagagcacccggaucuaccagauccucgcgaucuacuccaccguggccucgucccugguccugguggugagccucggcgccaucucguucuggaugugcuccaacgggagccugcagugccgcaucugcaucuga

SEQ ID NO: 10007 - RNA, 1701 nt, Artificial Sequence
  derived and/or modified CDS sequence (AUadapt) from InfluenzaA__AGB08296__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccggggccaggaggggcgcaugaacuacuacuggacccugguggagcccggcgacaagaucaccuucgaggcgacggggaaccucguggucccccgguacgccuucgccauggagcgcaccgccggcucgggcaucaucaucuccgacacccccgugcacgacugcaacaccacgugccagaccccgaagggggccaucaacaccagccugcccuuccagaacauccaccccaucaccaucggcaagugccccaaguacgugaaguccacgaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacccagaacgcgaucgacaagaucacgaacaaggugaacucggucaucgagaagaugaacacccaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgucccuggugcucguggucagccugggcgccaucucguucuggaugugcuccaacggcagccugcagugccggaucugcaucuga

SEQ ID NO: 10008 - RNA, 1701 nt, Artificial Sequence
  derived and/or modified CDS sequence (AUadapt) from InfluenzaA__AGB08297__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccgagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaccgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucacgaacaaggugaacucggucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 10009 - RNA, 1701 nt, Artificial Sequence
  derived and/or modified CDS sequence (AUadapt) from InfluenzaA__AGB08298__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuacccccggcuguccaagucguacaucaacgacaagggcaaggaggugcuggugcucugggggauccaccaccccagcaccacggccgaccagcagucccuguaccagaacgccgacgccuacgucuucgugggcaccucgcgcuacuccaagaaguucaagcccgagaucgccauccggccgaaggugcgcgaccaggagggccggaugaacuacuacuggacccuggucgagcccggggacaagaucaccuucgaggcgacgggcaaccucguggugccccgcuacgccuucgccauggagcggaccgccgggucgggcaucaucaucuccgacacccccguccacgacugcaacaccacgugccagaccccgaagggcgccaucaacaccagccugcccuuccagaacauccaccccaucaccaucgggaagugccccaaguacgugaaguccacgaagcugcgccucgcgaccggccugcggaacgugccgucgauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucacgaacaaggugaacucggugaucgagaagaugaacacccaguucaccgccgucggcaaggaguucaaccagcuggagaagcggaucgagaaccugaacaagaagguggacgacggcuuccucgacaucuggaccuacaacgccgagcugcugguccuccuggagaacgagcgcacgcuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 10010 - RNA, 1701 nt, Artificial Sequence
  derived and/or modified CDS sequence (AUadapt) from InfluenzaA__AGB08301__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccguggucaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacaacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 10011 - RNA, 1701 nt, Artificial Sequence
  derived and/or modified CDS sequence (AUadapt) from InfluenzaA__AGB08343__HA
augaagaccaucaucgcccugucguacaucuucugccucgugcuggcccaggaccugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcaacaacccccaccggauccuggacggcaucaacugcacccugaucgacgcccuccugggggacccccacugcgacggcuuccagaacaagaagugggaccuguucguggagcgcuccaaggccuucagcaacugcuaccccuacgacgugccggacuacgcgucccuccggucgcuggucgccuccagcggcacgcuggaguucaucaacgagggguucaacuggaccggcgugacccagaacgggggcuccuacgccugcaagcgcgggcccgacaacggcuucuucucgcggcucaacuggcuguacaaguccgagagcaccuaccccgugcugaacgucacgaugcccaacaacgacaacuucgacaagcucuacaucuggggcgugcaccacccguccaccgacaaggagcagaccaaccuguacgugcaggccucggggcgcgucaccguguccacgaagcggagccagcagaccaucauccccaacgugggcucccgccccuggguccgggggcugucgagccgcaucuccaucuacuggaccaucgugaagcccggcgacauccucgugaucaacucgaacggcaaccugaucgcgccgcggggguacuucaagauccgcaacggcaaguccagcaucaugcgguccgacgcccccaucgggaccugcucguccgagugcaucacgcccaacggcagcauccccaacgacaagccguuccagaacgucaacaagaucaccuacggggccugccccaaguacgugaagcagaacacccugaagcucgccaccggcaugcgcaacgugcccgagaagcagacgcggggcaucuucggggccaucgcgggcuucaucgagaacgggugggagggcaugaucgacgggugguacggcuuccgccaccagaacuccgagggcaccgggcaggccgccgaccucaagucgacccaggccgccaucgaccagaucaacggcaagcugaaccgggucaucgagaagaccaacgagaaguuccaccagaucgagaaggaguucuccgagguggaggggcgcauccaggaccucgagaaguacguggaggacacgaagaucgaccuguggagcuacaacgcggagcugcucgucgcccuggagaaccagcacaccaucgaccugaccgacuccgagaugaacaagcuguucgagaagacccggcgccagcugcgggagaacgccgaggacaugggcaacgggugcuucaagaucuaccacaagugcgacaacgccugcaucggcucgauccgcaacggcacguacgaccacgacguguaccgcgacgaggcccugaacaaccgguuccagaucaagggggucgagcucaaguccggcuacaaggacuggauccuguggaucagcuucgcgaucuccugcuuccugcucugcguggugcugcugggguucaucaugugggccugccagaagggcaacauccgcugcaacaucugcaucuga

SEQ ID NO: 10012 - RNA, 1701 nt, Artificial Sequence
  derived and/or modified CDS sequence (AUadapt) from InfluenzaA__AGB08362__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgacaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 10013 - RNA, 1701 nt, Artificial Sequence; identical to SEQ ID NO: 7067
  derived and/or modified CDS sequence (AUadapt) from InfluenzaA__AGB12986__HA

SEQ ID NO: 10014 - RNA, 1701 nt, Artificial Sequence; identical to SEQ ID NO: 7331
  derived and/or modified CDS sequence (AUadapt) from InfluenzaA__AGB13006__HA

SEQ ID NO: 10015 - RNA, 1701 nt, Artificial Sequence
  derived and/or modified CDS sequence (AUadapt) from InfluenzaA__AGB13016__HA
augaaggccauccuggugguccuccuguacaccaucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgaucggcaaccucguggucccccgguacgccuucgccauggagaagaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgucgauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcgcgcgggucuaccagauccuggccaucuacuccaccguggccucgucccuggugcucgucgugagccugggggccaucucguucuggaugugcuccaacggcagccugcagugccgcaucugcaucuga

SEQ ID NO: 10016 - RNA, 1701 nt, Artificial Sequence; identical to SEQ ID NO: 7112
  derived and/or modified CDS sequence (AUadapt) from InfluenzaA__AGB13026__HA

SEQ ID NO: 10017 - RNA, 1701 nt, Artificial Sequence; identical to SEQ ID NO: 7054
  derived and/or modified CDS sequence (AUadapt) from InfluenzaA__AGB13036__HA

SEQ ID NO: 10018 - RNA, 1701 nt, Artificial Sequence
  derived and/or modified CDS sequence (AUadapt) from InfluenzaA__AGB13048__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcaucgagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 10019 - RNA, 1701 nt, Artificial Sequence
  derived and/or modified CDS sequence (AUadapt) from InfluenzaA__AGB13066__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgugaagggcaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagcacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 10020 - RNA, 1701 nt, Artificial Sequence; identical to SEQ ID NO: 7154
  derived and/or modified CDS sequence (AUadapt) from InfluenzaA__AGB13082__HA

SEQ ID NO: 10021 - RNA, 1701 nt, Artificial Sequence; identical to SEQ ID NO: 7054
  derived and/or modified CDS sequence (AUadapt) from InfluenzaA__AGB13105__HA

SEQ ID NO: 10022 - RNA, 1701 nt, Artificial Sequence; identical to SEQ ID NO: 7112
  derived and/or modified CDS sequence (AUadapt) from InfluenzaA__AGB13125__HA

SEQ ID NO: 10023 - RNA, 1701 nt, Artificial Sequence; identical to SEQ ID NO: 7112
  derived and/or modified CDS sequence (AUadapt) from InfluenzaA__AGB13130__HA

SEQ ID NO: 10024 - RNA, 1701 nt, Artificial Sequence
  derived and/or modified CDS sequence (AUadapt) from InfluenzaA__AGB13140__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagccucugguccuacaucguggagaccucguccagcgacaacggcacgugcuaccccggcgacuucaucgacuacgaggagcugcgggagcagcuguccucgguguccagcuucgagcgcuucgagaucuuccccaagaccuccucguggcccaaccacgacuccaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccacggccgaccagcagagccuguaccagaacgccgacaccuacguguucgugggcaccucccgguacucgaagaaguucaagcccgagaucgccauccgcccgaagguccgggaccaggagggccgcaugaacuacuacuggacccucguggagcccggggacaagaucacguucgaggccaccggcaaccugguggucccccgguacgcguucgccauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcuccggcuggccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacucgaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggccaucuacucgaccgucgcguccagccucgugcugguggucucccugggggccaucucguucuggaugugcagcaacggcucccuccagugccggaucugcaucuga
